US012503696B2

(12) United States Patent
Ngai et al.

(10) Patent No.: US 12,503,696 B2
(45) Date of Patent: Dec. 23, 2025

(54) RNAi AGENTS FOR INHIBITING EXPRESSION OF INHIBIN SUBUNIT BETA E (INHBE), PHARMACEUTICAL COMPOSITIONS THEREOF, AND METHODS OF USE

(71) Applicant: Arrowhead Pharmaceuticals, Inc., Pasadena, CA (US)

(72) Inventors: Michelle Ngai, Fitchburg, WI (US); Feng Liu, Valley Center, CA (US); Puhui Li, San Diego, CA (US); Xiaokai Li, San Diego, CA (US); Zhi-Ming Ding, Waunakee, WI (US); Tao Pei, Middleton, WI (US); Daniel Braas, Madison, WI (US); So Wong, Oregon, WI (US); James C. Hamilton, Sierra Madre, CA (US); Grigoriy Shekhtman, Los Angeles, CA (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 18/819,737

(22) Filed: Aug. 29, 2024

(65) Prior Publication Data

US 2025/0075214 A1 Mar. 6, 2025

Related U.S. Application Data

(60) Provisional application No. 63/683,209, filed on Aug. 14, 2024, provisional application No. 63/634,173, (Continued)

(51) Int. Cl.
*C12N 15/113* (2010.01)

(52) U.S. Cl.
CPC ........ *C12N 15/113* (2013.01); *C12N 2310/14* (2013.01); *C12N 2310/313* (2013.01); (Continued)

(58) Field of Classification Search
CPC .............. C12N 15/113; C12N 2310/14; C12N 2310/313; C12N 2310/315; C12N 2310/321; C12N 2310/322
See application file for complete search history.

(56) References Cited

U.S. PATENT DOCUMENTS 4,522,811 A 6/1985 Eppstein et al.
5,885,968 A 3/1999 Rijksuniversiteit et al.
(Continued)

FOREIGN PATENT DOCUMENTS

WO 2000053722 A2 9/2000
WO 2008022309 A2 2/2008
(Continued)

OTHER PUBLICATIONS

Ralston (2008. Gene interaction and disease. Nature Education 1[1]:16) (Year: 2008).*
(Continued)

*Primary Examiner* — Nancy J Leith
*Assistant Examiner* — Ruth Sophia Arieti
(74) *Attorney, Agent, or Firm* — Paul VanderVelde; Meibo Chen; Mitchell Porter

(57) ABSTRACT

The present disclosure relates to RNAi agents, e.g., double stranded RNAi agents such as siRNAs, able to Inhibin Subunit Beta E (INHBE) gene expression. Also disclosed are pharmaceutical compositions that include INHBE RNAi agents and methods of use thereof. The INHBE RNAi agents disclosed herein may be conjugated to targeting ligands to facilitate the delivery to cells, including to hepatocytes. Delivery of the INHBE RNAi agents in vivo provides for inhibition of INHBE gene expression. The RNAi agents can be used in methods of treatment of diseases, disorders, or
(Continued)

symptoms mediated in part by INHBE gene expression, such as obesity, diabetes, liver inflammation, dyslipidemia, or metabolic disease.

16 Claims, 32 Drawing Sheets

Specification includes a Sequence Listing.

Related U.S. Application Data filed on Apr. 15, 2024, provisional application No. 63/618,015, filed on Jan. 5, 2024, provisional application No. 63/579,708, filed on Aug. 30, 2023.

(52) U.S. Cl.
CPC .. *C12N 2310/315* (2013.01); *C12N 2310/321* (2013.01); *C12N 2310/322* (2013.01)

(56) References Cited

U.S. PATENT DOCUMENTS

| | | | | |
|---|---|---|---|---|
| 5,998,203 | A | 12/1999 | Matulic-Adamic et al. | |
| 2022/0184114 | A1 | 6/2022 | Lotta et al. | |
| 2023/0172963 | A1 * | 6/2023 | Lotta .......................... | A61P 9/00 514/23 |
| 2024/0309370 | A1 * | 9/2024 | Deaton ................ | C12N 15/113 |

FOREIGN PATENT DOCUMENTS

| | | | | |
|---|---|---|---|---|
| WO | 2011104169 | A1 | 9/2011 | |
| WO | 2012083185 | A2 | 6/2012 | |
| WO | 2013032829 | A1 | 3/2013 | |
| WO | 2013158141 | A1 | 10/2013 | |
| WO | 2017156012 | A1 | 9/2017 | |
| WO | 2017214112 | A1 | 12/2017 | |
| WO | 2018044350 | A1 | 3/2018 | |
| WO | WO-2020061177 | A1 * | 3/2020 | ........... A61K 31/713 |
| WO | 2023003922 | A1 | 1/2023 | |
| WO | 2023044094 | A1 | 3/2023 | |
| WO | WO-2024187190 | A2 * | 9/2024 | |

OTHER PUBLICATIONS

Crooke (et al. 2008. Mechanisms of Antisense Drug Action, an Introduction. Chapter 1 in Antisense Drug Technology, 2nd Ed. Florida: CRC Press) (Year: 2008).*

Deaton (et al. 2022. Rare loss of function variants in the hepatokine gene INHBE protect from abdominal obesity. Nat. Comm. 13: 4319 (Year: 2022).*

Cao (et al. 2023. Identification and validation of INHBE and P4HA1 as hub genes in non-alcoholic fatty liver disease. Biochem. Biophys. Res. Comm. 686:1491800 (Year: 2023).*

Altenhofer EF, Lawler MJ, Kumar P, Joyce LA, Fowler-Watters M, Pei T, Li Z. Synthesis of a novel cyclopropyl phosphonate nucleotide as a phosphate mimic. Chem Commun (Camb). Jul. 14, 2021;57(55):6808-6811. doi: 10.1039/d1cc02328d. Epub Jun. 18, 2021. PMID: 34142689.

Baenziger JU, Fiete D. Galactose and N-acetylgalactosamine-specific endocytosis of glycopeptides by isolated rat hepatocytes. Cell. Nov. 1980;22(2 Pt 2):611-20. doi: 10.1016/0092-8674(80)90371-2. PMID: 7448875.

Biessen EA, Beuting DM, Roelen HC, van de Marel GA, van Boom JH, van Berkel TJ. Synthesis of cluster galactosides with high affinity for the hepatic asialoglycoprotein receptor. J Med Chem. Apr. 28, 1995;38(9):1538-46. doi: 10.1021/jm00009a014. PMID: 7739012.

Connolly DT, Townsend RR, Kawaguchi K, Bell WR, Lee YC. Binding and endocytosis of cluster glycosides by rabbit hepatocytes. Evidence for a short-circuit pathway that does not lead to degradation. J Biol Chem. Jan. 25, 1982;257(2):939-45. PMID: 7054189.

Czauderna F, Fechtner M, Dames S, Aygün H, Klippel A, Pronk GJ, Giese K, Kaufmann J. Structural variations and stabilising modifications of synthetic siRNAs in mammalian cells. Nucleic Acids Res. Jun. 1, 2003;31(11):2705-16. doi: 10.1093/nar/gkg393. PMID: 12771196; PMCID: PMC156727.

Deaton AM, Dubey A, Ward LD, Dornbos P, Flannick J; AMP-T2D-GENES Consortium; Yee E, Ticau S, Noetzli L, Parker MM, Hoffing RA, Willis C, Plekan ME, Holleman AM, Hinkle G, Fitzgerald K, Vaishnaw AK, Nioi P. Rare loss of function variants in the hepatokine gene INHBE protect from abdominal obesity. Nat Commun. Jul. 27, 2022;13(1):4319. doi: 10.1038/s41467-022-31757-8. PMID: 35896531; PMCID: PMC9329324.

Iobst ST, Drickamer K. Selective sugar binding to the carbohydrate recognition domains of the rat hepatic and macrophage asialoglycoprotein receptors. J Biol Chem. Mar. 22, 1996;271(12):6686-93. doi: 10.1074/jbc.271.12.6686. PMID: 8636087.

Sugiyama M, Kikuchi A, Misu H, Igawa H, Ashihara M, Kushima Y, Honda K, Suzuki Y, Kawabe Y, Kaneko S, Takamura T. Inhibin βe (INHBE) is a possible insulin resistance-associated hepatokine identified by comprehensive gene expression analysis in human liver biopsy samples. PLoS One. Mar. 29, 2018;13(3):e0194798. doi: 10.1371/journal.pone.0194798. PMID: 29596463; PMCID: PMC5875797.

GenBank NM_031479.5; "*Homo sapiens* inhibin subunit beta E (INHBE), mRNA" (2023).

GenBank NM_008382.3; "Mus musculus inhibin beta-E (INHBE), mRNA" (2023).

International Search Report for corresponding International Application No. PCT/US2024/044473, mailed on Dec. 4, 2024.

* cited by examiner

RNAi AGENTS FOR INHIBITING EXPRESSION OF INHIBIN SUBUNIT BETA E (INHBE), PHARMACEUTICAL COMPOSITIONS THEREOF, AND METHODS OF USE

CROSS REFERENCE TO RELATED APPLICATIONS

This application claims the benefit of priority to U.S. Provisional Patent Application Ser. No. 63/579,708, filed on Aug. 30, 2023, U.S. Provisional Patent Application Ser. No. 63/618,015, filed on Jan. 5, 2024, U.S. Provisional Patent Application Ser. No. 63/634,173, filed on Apr. 15, 2024, and U.S. Provisional Patent Application Ser. No. 63/683,209, filed on Aug. 14, 2024, the contents of each of which are incorporated herein by reference in their entirety.

FIELD OF THE INVENTION

The present disclosure relates to RNA interference (RNAi) agents, e.g., double stranded RNAi agents such as small or short interfering RNA (siRNA), for inhibition of Inhibin Subunit Beta E (INHBE), pharmaceutical compositions that include INHBE RNAi agents, and methods of use thereof.

SEQUENCE LISTING

This application contains a Sequence Listing (in compliance with Standard ST26), which has been submitted in xml format and is hereby incorporated by reference in its entirety. The xml sequence listing file is named 30713-US1 SeqListing_Replacement.xml, created Feb. 3, 2025, and is 3172 kb in size.

BACKGROUND

Inhibin subunit beta E (INHBE) is primarily expressed in the liver and encodes for a preproprotein that is proteolytically cleaved to release a mature beta peptide. Homodimerization of the mature peptides leads to the production of activin E proteins. As members of the transforming growth factor-beta (TGFbeta) superfamily, activin proteins regulate the transcript of target genes through SMAD activation, and literature implicates their role in the regulation of growth, body composition, adiposity, and energy metabolism.

In a whole-exome sequencing study, researchers identified rare variants (NM_031479.4:c.299-1 G>C, NM_0314794.4:C.298+1 G>T, p.Tyr253Ter) with a predicted loss-of-function that are associated with a reduced abdominal obesity phenotype and favorable cardiometabolic profile (Deaton A M, et al., Rare loss of function variants in the hepatokine gene INHBE protect from abdominal obesity, Nat Commun. (July 2022); 13:4319). Heterozygous carriers of these variants are associated with a decreased waist-to-hip adjusted BMI, lower triglycerides, higher HDL cholesterol, decreased alanine aminotransferase, and lower fasting glucose. Fewer cases of type 2 diabetes mellitus and coronary heart disease is also discovered in carriers of these INHBE loss-of-function variants. Additionally, RNA expression analyses on liver biopsies shows an increased INHBE expression in obese monkeys with NAFLD versus lean monkeys. The findings in this study supported previous smaller-scale studies that identified INHBE as a candidate target gene for metabolic regulation.

INHBE is relatively understudied and a mechanism-of-action underlying its association with abdominal obesity is not yet fully understood. However, a pre-clinical study utilizing siRNA to knockdown INHBE in a diabetes murine model demonstrated that a modest reduction of INHBE can lead to a suppression in body weight gain, increase in lean mass composition, and decrease in fat mass volume (Sugiyama M, et al., Inhibin E (INHBE) is a possible insulin resistance-associated hepatokine identified by comprehensive gene expression analysis in human liver biopsy samples, PLoS ONE. (February 2018); 13(3):e0194798). These lines of evidence suggest that INHBE is a potential therapeutic target, and inhibition may lead to a favorable phenotype with respect to abdominal obesity and cardiometabolic disease.

SUMMARY

Disclosed herein are RNAi agents for inhibiting expression of an INHBE gene, comprising an antisense strand comprising at least 17 contiguous nucleotides differing by 0 or 1 nucleotides from any one of the sequences of Table 2, Table 3, or Table 5C; and a sense strand comprising a nucleotide sequence that is at least partially complementary to the antisense strand.

In some embodiments, the antisense strand comprises nucleotides 2-18 of any one of the sequences of Table 2, Table 3, or Table 5C.

In some embodiments, the sense strand comprises a nucleotide sequence of at least 15 contiguous nucleotides differing by 0 or 1 nucleotides from 15 contiguous nucleotides of any one of the sense strand sequences of Table 2 or Table 4, and wherein the sense strand has a region of at least 85% complementarity over the 15 contiguous nucleotides to the antisense strand.

In some embodiments, at least one nucleotide of the RNAi agent is a modified nucleotide or includes a modified internucleoside linkage.

According to some embodiments, all or substantially all of the nucleotides of the sense and/or antisense strand of the RNAi agent are modified nucleotides.

In some embodiments, the modified nucleotide is selected from the group consisting of: 2'-O-methyl nucleotide, 2'-fluoro nucleotide, 2'-deoxy nucleotide, 2',3'-seco nucleotide mimic, locked nucleotide, 2-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholine nucleotide, vinyl phosphonate-containing nucleotide, cyclopropyl phosphonate-containing nucleotide, and 3'-O-methyl nucleotide.

In certain embodiments, the all or substantially all of the modified nucleotides are 2'-O-methyl nucleotides, 2'-fluoro nucleotides, or combinations thereof.

In some embodiments, the antisense strand consists of, consists essentially of, or comprises the nucleotide sequence of any one of the modified antisense strand sequences of Table 3.

In some embodiments, the sense strand consists of, consists essentially of, or comprises the nucleotide sequence of any of the modified sense strand sequences of Table 4.

In some embodiments, the antisense strand comprises the nucleotide sequence of any one of the modified sequences of Table 3 and the sense strand comprises the nucleotide sequence of any one of the modified sequences of Table 4.

In certain embodiments, the RNAi agents are linked to a targeting ligand. In some embodiments, the targeting ligand comprises N-acetyl-galactosamine. In certain embodiments, the targeting ligand comprises the structure of (NAG37) or (NAG37)s. In certain embodiments, the targeting ligand is linked to the sense strand. In some embodiments, the targeting ligand is linked to the 5' terminal end of the sense strand.

In some embodiments, the sense strand is between 15 and 30 nucleotides in length, and the antisense strand is between 18 and 30 nucleotides in length. In other embodiments, the sense strand and the antisense strand are each between 18 and 27 nucleotides in length. In other embodiments, the sense strand and the antisense strand are each between 18 and 24 nucleotides in length. In still other embodiments, sense strand and the antisense strand are each 21 nucleotides in length.

In some embodiments, the RNAi agents have two blunt ends.

In some embodiments, the sense strand comprises one or two terminal caps. In other embodiments, the sense strand comprises one or two inverted abasic residues.

In some embodiments, the RNAi agents are comprised of a sense strand and an antisense strand that form a duplex sequence of any one of the duplex structures shown in Table 5A, 5B or 5C.

In some embodiments, the sense strand further includes inverted abasic residues at the 3' terminal end of the nucleotide sequence, at the 5' end of the nucleotide sequence, or at both.

In some embodiments, the sense strand of the RNAi agents is linked to a targeting ligand. In some embodiments, the targeting ligand has affinity for the asialoglycoprotein receptor. In some embodiments, the targeting ligand comprises N-acetyl-galactosamine.

In further embodiments, the targeting ligand comprises:

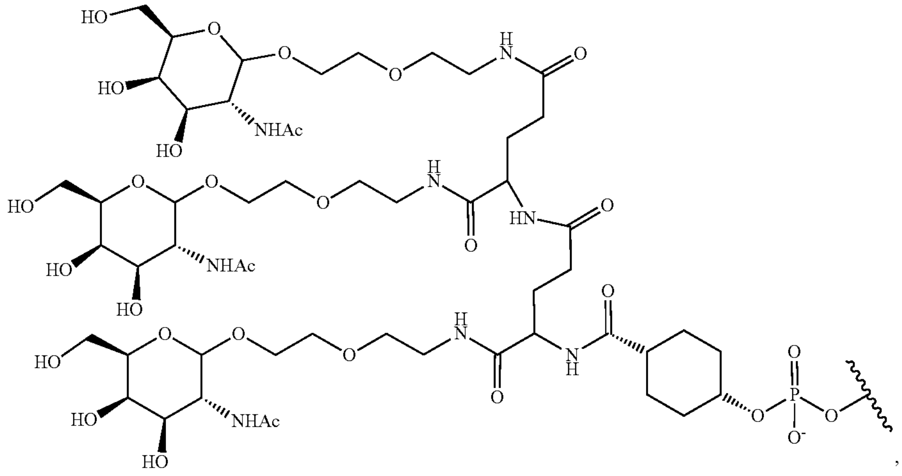

, or

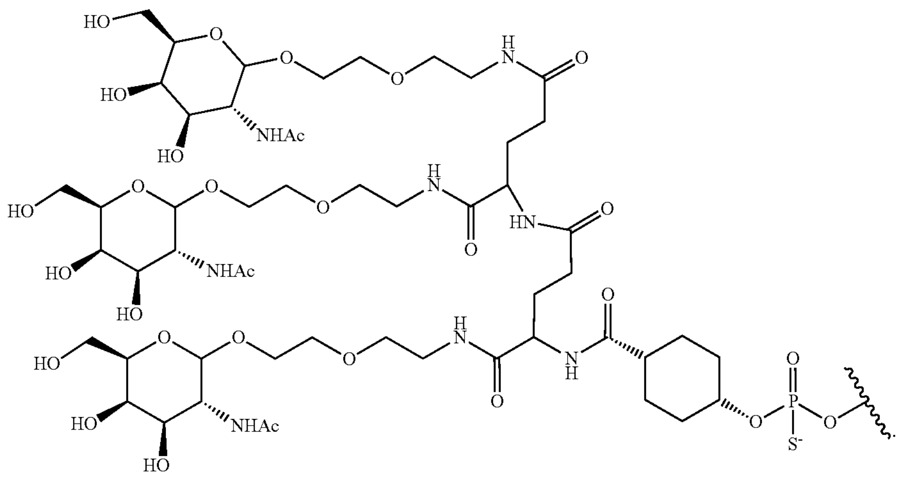

Also disclosed herein are compositions comprising the disclosed RNAi agents, wherein the compositions further comprise a pharmaceutically acceptable excipient.

Also provided herein are methods for inhibiting expression of an INHBE gene in a cell, the methods comprising introducing into a cell an effective amount of the disclosed RNAi agents or the disclosed compositions.

In some embodiments, the cell is within a subject. In some embodiments, the subject is a human subject.

In some embodiments, the INHBE gene expression is inhibited by at least about 30%. In some embodiments, the INHBE gene expression is inhibited by at least about 50% in the cytoplasm of hepatocytes.

Further provided herein are methods of treating an INHBE-related disease, disorder, or symptom, the methods comprising administering to a human subject in need thereof a therapeutically effective amount of the disclosed compositions.

In some embodiments, the disease is obesity, diabetes, liver inflammation, dyslipidemia, or metabolic disease.

In some embodiments, the RNAi agents are administered at a dose of about 0.05 mg/kg to about 5.0 mg/kg of body weight of the human subject.

In other embodiments, the RNAi agent is administered in two or more doses.

Also provided herein are usages of the disclosed RNAi agents or the disclosed compositions, for the treatment of a disease, disorder, or symptom that is mediated at least in part by INHBE gene expression.

In some embodiments, the disease is obesity, diabetes, liver inflammation, dyslipidemia, or metabolic disease.

Further provided herein are usages of the disclosed RNAi agents or the disclosed compositions, for the preparation of a pharmaceutical compositions for treating a disease, disorder, or symptom that is mediated at least in part by INHBE gene expression.

In some embodiments, the RNAi agent is administered at a dose of about 0.05 mg/kg to about 5.0 mg/kg of body weight of the human subject.

BRIEF DESCRIPTION OF THE FIGURES/DRAWINGS

FIG. 1A. Test animal percent body weight change after dosing with INHBE RNAi agent (see Example 10 herein).

FIG. 1B. Test animal body fat percentage after dosing with INHBE RNAi agent (see Example 10 herein).

FIG. 1C. Test animal body fat mass after dosing with INHBE RNAi agent (see Example 10 herein).

FIG. 1D. Test animal body lean percentage after dosing with INHBE RNAi agent (see Example 10 herein).

FIG. 1E. Test animal body lean mass after dosing with INHBE RNAi agent (see Example 10 herein).

FIG. 1F. Test animal fasting glucose after dosing with INHBE RNAi agent (see Example 10 herein).

FIG. 1G. Test animal fasting insulin after dosing with INHBE RNAi agent (see Example 10 herein).

FIG. 1H. Test animal HOMA-IR after dosing with INHBE RNAi agent (see Example 10 herein).

FIG. 1I. Test animal glucose post glucose bolus after dosing with INHBE RNAi agent (see Example 10 herein).

FIG. 1J. Test animal AUC glucose tolerance test after dosing with INHBE RNAi agent (see Example 10 herein).

FIG. 2A. Test animal percent body weight change after dosing with INHBE RNAi agent (see Example 11 herein).

FIG. 2B. Test animal body fat percentage after dosing with INHBE RNAi agent (see Example 11 herein).

FIG. 2C. Test animal body fat mass after dosing with INHBE RNAi agent (see Example 11 herein).

FIG. 2D. Test animal body lean percentage after dosing with INHBE RNAi agent (see Example 11 herein).

FIG. 2E. Test animal body lean mass after dosing with INHBE RNAi agent (see Example 11 herein).

FIG. 2F. Test animal fasting glucose after dosing with INHBE RNAi agent (see Example 11 herein).

FIG. 2G. Test animal glucose post glucose bolus after dosing with INHBE RNAi agent (see Example 11 herein).

FIG. 2H. Test animal AUC glucose tolerance test after dosing with INHBE RNAi agent (see Example 11 herein).

FIG. 3. Proposed Clinical Study Schema for Part 1 (Cohorts 1-4) of a Phase 1/2a dose-escalating study to evaluate the safety, tolerability, pharmacokinetics, and pharmacodynamics of single and multiple doses of an INHBE RNAi agent, showing dosing for adult volunteers with obesity (see Example 21 herein). "ARO-INHBE" represents an INHBE RNAi agent-conjugate in accordance with the disclosure herein.

FIG. 4. Proposed Clinical Study Schema for Part 2 of a Phase 1/2a dose-escalating study to evaluate the safety, tolerability, and pharmacodynamics of multiple repeat doses of an INHBE RNAi agent in combination with a GLP-1/GIP agonist (tirzepatide (TZP)), showing dosing for adult volunteers with obesity with and without type 2 diabetes mellitus (see Example 21 herein). "ARO-INHBE" represents an INHBE RNAi agent-conjugate in accordance with the disclosure herein.

DETAILED DESCRIPTION

Figure 1A:
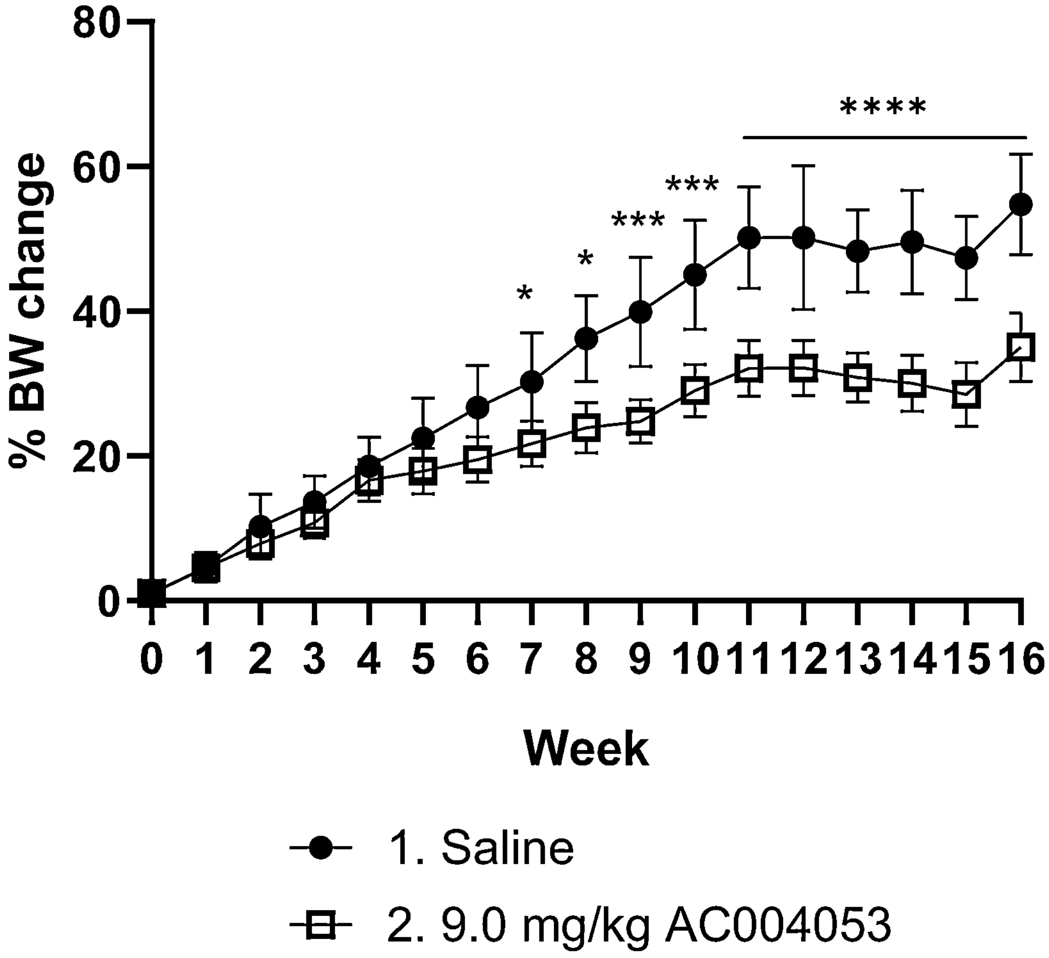

The disclosed RNAi agents, compositions thereof, and methods of use may be understood more readily by reference to the following detailed description, which form a part of this disclosure. It is to be understood that the disclosure is not limited to what is specifically described and/or shown herein, and that the terminology used herein is for the purpose of describing particular embodiments by way of example only and is not intended to be limiting.

It is to be appreciated that while certain features of the disclosures included herein are, for clarity, described herein in the context of separate embodiments, they may also be provided in combination in a single embodiment. Conversely, various features of the disclosed methods that are, for brevity, described in the context of a single embodiment, may also be provided separately or in any subcombination.

Definitions

As used herein, an "RNAi agent" means a composition that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target gene in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: short (or small) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e. INHBE mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature. A nucleic acid molecule can comprise unmodified and/or modified nucleotides. A nucleotide sequence can comprise unmodified and/or modified nucleotides.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, the term "nucleotide" has the same meaning as commonly understood in the art. Thus, the term "nucleotide" as used herein, refers to a glycoside comprising a sugar moiety, a base moiety and a covalently linked group (linkage group), such as a phosphate, phosphorothioate, or phosphorodithioate internucleoside linkage group, and covers both naturally occurring nucleotides, such as DNA or RNA, and non-naturally occurring nucleotides comprising modified sugar and/or base moieties, which are also referred to as nucleotide analogs herein. Herein, a single nucleotide can be referred to as a monomer or unit.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions)) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an INHBE mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The subject matter disclosed herein encompass nucleotide sequences substantially identical to those disclosed herein.

As used herein, the terms "individual", "patient" and "subject", are used interchangeably to refer to a member of any animal species including, but not limited to, birds, humans and other primates, and other mammals including commercially relevant mammals or animal models such as mice, rats, monkeys, cattle, pigs, horses, sheep, cats, and dogs. Preferably, the subject is a human.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol  as used herein means that any group or groups may be linked thereto that is in accordance with the scope of the subject matters described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Where a value is explicitly recited, it is to be understood that values which are about the same quantity or amount as the recited value are also within the scope of the disclosure. Where a combination is disclosed, each sub-combination of the elements of that combination is also specifically disclosed and is within the scope of the disclosure. Conversely, where different elements or groups of elements are individually disclosed, combinations thereof are also disclosed. Where any element of a disclosure is disclosed as having a plurality of alternatives, examples of that disclosure in which each alternative is excluded singly or in any combination with the other alternatives are also hereby disclosed; more than one element of a disclosure can have such exclusions, and all combinations of elements having such exclusions are hereby disclosed.

The term "about" or "approximately" as used herein when referring to a measurable value such as a parameter, an amount, a temporal duration, and the like, is meant to encompass variations of +/−20% or less, +/−10% or less, +/−5% or less, or +/−1% or less of and from the specified value, insofar such variations are appropriate to perform in the present disclosure. It is to be understood that the value to which the modifier "about" or "approximately" refers is itself. For example, "about 4" includes 4.

Other objects, features, embodiments, and advantages of the invention will be apparent from the following detailed description, accompanying figures, and from the claims.

RNAi Agents

Described herein are RNAi agents for inhibiting expression of an INHBE gene. Each INHBE RNAi agent comprises a sense strand and an antisense strand. The sense strand can be 15 to 49 nucleotides in length. The antisense strand can be 18 to 49 nucleotides in length. The sense and antisense strands can be either the same length or they can be different lengths. In some embodiments, the sense and antisense strands are each independently 18 to 27 nucleotides in length. In some embodiments, both the sense and antisense strands are each 21-26 nucleotides in length. In some embodiments, the sense and antisense strands are each 21-24 nucleotides in length. In some embodiments, the sense and antisense strands are each independently 19-21 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent antisense strands are each 18, 19, 20, 21, 22, 23, 24, 25, 26, 27, 28, 29, or 30 nucleotides in length. In some embodiments, the RNAi agent sense strands are each 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The sense and antisense strands are annealed to form a duplex, and in some embodiments, a double-stranded RNAi agent has a duplex length of about 15, 16, 17, 18, 19, 20, 21, 22, 23 or 24 nucleotides.

Examples of nucleotide sequences used in forming INHBE RNAi agents are provided in Tables 2, 3, 4, and 5C. Examples of RNAi agent duplexes, that include the sense strand and antisense strand sequences in Tables 2, 3, 4 and 5C, are shown in Tables 5A, 5B and 5C.

In some embodiments, the region of perfect, substantial, or partial complementarity between the sense strand and the antisense strand is 15-26 (e.g., 15, 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the INHBE RNAi agents described herein includes at least 15 consecutive nucleotides that have at least 85% identity to a core stretch sequence (also referred to herein as a "core stretch" or "core sequence") of the same number of nucleotides in an INHBE mRNA. In some embodiments, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the INHBE mRNA target. In some embodiments, this sense strand core stretch is 15, 16, 17, 18, 19, 20, 21, 22, or 23 nucleotides in length. In some embodiments, this sense strand core stretch is 17 nucleotides in length. In some embodiments, this sense strand core stretch is 19 nucleotides in length.

An antisense strand of an INHBE RNAi agent described herein includes at least 15 consecutive nucleotides that have at least 85% complementarity to a core stretch of the same number of nucleotides in an INHBE mRNA and to a core stretch of the same number of nucleotides in the corresponding sense strand. In some embodiments, an antisense strand core stretch is 100% (perfectly) complementary or at least about 85% (substantially) complementary to a nucleotide sequence (e.g., target sequence) of the same length present in the INHBE mRNA target. In some embodiments, this antisense strand core stretch is 15, 16, 17, 18, 19, 20, 21, 22, or 23 nucleotides in length. In some embodiments, this antisense strand core stretch is 19 nucleotides in length. In some embodiments, this antisense strand core stretch is 17 nucleotides in length. A sense strand core stretch sequence can be the same length as a corresponding antisense core sequence or it can be a different length.

The INHBE RNAi agent sense and antisense strands anneal to form a duplex. A sense strand and an antisense strand of an INHBE RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 15, at least 16, at least 17, at least 18, at least 19, at least 20, at least 21, at least 22, at least 23, at least 24, or at least 25 nucleotides that is at least 85% or 100% complementary to a corresponding 15, 16, 17, 18, 19, 20, 21, 22, 23, 24, or 25 nucleotide sequence of the antisense strand core stretch sequence (i.e., the sense and antisense core stretch sequences of an INHBE RNAi agent have a region of at least 15, at least 16, at least 17, at least 18, at least 19, at least 20, at least 21, at least 22, at least 23, at least 24, or at least 25 nucleotides that is at least 85% base paired or 100% base paired.)

In some embodiments, the antisense strand of an INHBE RNAi agent disclosed herein differs by 0, 1, 2, or 3 nucleotides from any of the antisense strand sequences in Table 2, Table 3, or Table 5C. In some embodiments, the sense strand of an INHBE RNAi agent disclosed herein differs by 0, 1, 2, or 3 nucleotides from any of the sense strand sequences in Table 2, Table 4, or Table 5C.

In some embodiments, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the INHBE mRNA. The sense strand additional nucleotides, if present, may or may not be identical to the corresponding sequence in the INHBE mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, an INHBE RNAi agent has an antisense strand having a 3' extension and a sense strand having a 5' extension. In some embodiments, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some embodiments, an INHBE RNAi agent comprises an antisense strand having a 3' extension of 1, 2, 3, 4, 5, or 6 nucleotides in length. In other embodiments, an INHBE RNAi agent comprises an antisense strand having a 3' extension of 1, 2, or 3 nucleotides in length. In some embodiments, one or more of the antisense strand extension nucleotides comprise nucleotides that are complementary to the corresponding INHBE mRNA sequence. In some embodiments, one or more of the antisense strand extension nucleotides comprise nucleotides that are not complementary to the corresponding INHBE mRNA sequence.

In some embodiments, an INHBE RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to or are the identical to nucleotides in the INHBE mRNA sequence. In some embodiments, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some embodiments, an INHBE RNAi agent comprises a sense strand having a 5' extension of 1, 2, 3, 4, 5, or 6 nucleotides in length. In some embodiments, one or more of the sense strand extension nucleotides comprise nucleotides that correspond to or are identical to nucleotides in the INHBE mRNA sequence.

Examples of sequences used in forming INHBE RNAi agents are provided in Tables 2, 3, 4, and 5C. In some embodiments, an INHBE RNAi agent antisense strand includes a sequence of any of the sequences in Tables 2, 3, or 5C. In certain embodiments, an INHBE RNAi agent antisense strand comprises or consists of any one of the modified sequences in Table 3. In some embodiments, an INHBE RNAi agent antisense strand includes the sequence of nucleotides (from 5' end→3' end) at positions 1-17, 2-15, 2-17, 1-18, 2-18, 1-19, 2-19, 1-20, 2-20, 1-21, or 2-21, of any of the sequences in Tables 2, 3, or 5C. In some embodiments, an INHBE RNAi agent sense strand includes the sequence of any of the sequences in Tables 2, 4, or 5C. In some embodiments, an INHBE RNAi agent sense strand includes the sequence of nucleotides (from 5' end→3' end) at positions 1-18, 1-19, 1-20, 1-21, 2-19, 2-20, 2-21, 3-20, 3-21, or 4-21 of any of the sequences in Tables 2, 4, or 5C. In certain embodiments, an INHBE RNAi agent sense strand comprises or consists of a modified sequence of any one of the modified sequences in Table 4.

As used herein a "blunt end" refers to an end of a double stranded RNAi agent in which the terminal nucleotides of the two annealed strands are complementary (form a complementary base-pair). In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended.

As used herein a "frayed end" refers to an end of a double stranded RNAi agent in which the terminal nucleotides of the two annealed strands from a pair (i.e., do not form an overhang) but are not complementary (i.e. form a non-complementary pair). In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The INHBE RNAi agents disclosed herein may also be comprised of one or more modified nucleotides. In some embodiments, substantially all of the nucleotides of the sense strand and substantially all of the nucleotides of the antisense strand of the INHBE RNAi agent are modified nucleotides. The INHBE RNAi agents disclosed herein may further be comprised of one or more modified internucleoside linkages, e.g., one or more phosphorothioate, or phosphorodithioate linkages. In some embodiments, an INHBE RNAi agent contains one or more modified nucleotides and one or more modified internucleoside linkages. In some embodiments, a 2'-modified nucleotide is combined with modified internucleoside linkage.

In some embodiments, an INHBE RNAi agent is prepared or provided as a salt, mixed salt, or a free-acid. In some embodiments, an INHBE RNAi agent is prepared as a pharmaceutically acceptable salt. In some embodiments, an INHBE RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administering of the oligonucleotide construct.

In some embodiments, an INHBE RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholine nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides, 2'-fluoro nucleotides (also referred to herein as 2'-deoxy-2'-fluoro nucleotides), 2'-deoxy nucleotides, 2'-methoxyethyl (2'-O-2-methoxylethyl) nucleotides (also referred to as 2'-MOE), 2'-amino nucleotides, and 2'-alkyl nucleotides. It is not necessary for all positions in a given compound to be uniformly modified. Conversely, more than one modification can be incorporated in a single INHBE RNAi agent or even in a single nucleotide thereof. The INHBE RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and 0-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. In some embodiments, an abasic residue can be placed internally in a nucleotide sequence. In some embodiments, Ab or AbAb can be added to the 3' end of the antisense strand. In some embodiments, the 5' end of the sense strand can include one or more additional abasic residues (e.g., (Ab) or (AbAb)). In some embodiments, UUAb, UAb, or Ab are added to the 3' end of the sense strand. In some embodiments, an abasic (deoxyribose) residue can be replaced with a ribitol (abasic ribose) residue.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense sense strand wherein substantially all of the nucleotides present are modified nucleotides is an antisense strand having two or fewer (i.e., 0, 1, or 2) nucleotides in the antisense strand being unmodified ribonucleotides. In some embodiments, one or more nucleotides of an RNAi agent is an unmodified ribonucleotide. Chemical structures for certain modified nucleotides are set forth in Table 6 herein.

Modified Internucleoside Linkages

In some embodiments, one or more nucleotides of an INHBE RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), phosphorodithioate groups (represented herein as lower case "ss"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some embodiments, a sense strand of an INHBE RNAi agent can contain 1, 2, 3, 4, 5, or 6 phosphorothioate or phosphorodithioate linkages, an antisense strand of an INHBE RNAi agent can contain 1, 2, 3, 4, 5, or 6 phosphorothioate or phosphorodithioate linkages, or both the sense strand and the antisense strand independently can contain 1, 2, 3, 4, 5, or 6 phosphorothioate or phosphorodithioate linkages. In some embodiments, a sense strand of an INHBE RNAi agent can contain 1, 2, 3, or 4 phosphorothioate or phosphorodithioate linkages, an antisense strand of an INHBE RNAi agent can contain 1, 2, 3, or 4 phosphorothioate or phosphorodithioate linkages, or both the sense strand and the antisense strand independently can contain 1, 2, 3, or 4 phosphorothioate or phosphorodithioate linkages.

In some embodiments, an INHBE RNAi agent sense strand contains at least two phosphorothioate or phosphorodithioate internucleoside linkages. In some embodiments, the phosphorothioate or phosphorodithioate internucleoside linkages are between the nucleotides at positions 1-3 from the 3' end of the sense strand. In some embodiments, one phosphorothioate or phosphorodithioate internucleoside linkage is at the 5' end of the sense strand nucleotide sequence, and another phosphorothioate or phosphorodithioate linkage is at the 3' end of the sense strand nucleotide sequence. In some embodiments, two phosphorothioate or phosphorodithioate internucleoside linkages are located at the 5' end of the sense strand, and another phosphorothioate or phosphorodithioate linkage is at the 3' end of the sense strand. In some embodiments, the sense strand does not include any phosphorothioate or phosphorodithioate internucleoside linkages between the nucleotides, but contains one, two, or three phosphorothioate or phosphorodithioate linkages between the terminal nucleotides on both the 5' and 3' ends and the optionally present inverted abasic residue terminal caps. In some embodiments, the targeting ligand is linked to the sense strand via a phosphorothioate or phosphorodithioate linkage.

In some embodiments, an INHBE RNAi agent antisense strand contains four phosphorothioate or phosphorodithioate internucleoside linkages. In some embodiments, the four phosphorothioate or phosphorodithioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate or phosphorodithioate internucleoside linkages are located between positions 1-4 from the 5' end of the antisense strand, and a fourth phosphorothioate or phosphorodithioate internucleoside linkage is located between positions 20-21 from the 5' end of the antisense strand. In some embodiments, an INHBE RNAi agent contains at least three or four phosphorothioate or phosphorodithioate internucleoside linkages in the antisense strand.

Capping Residues or Moieties

In some embodiments, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some embodiments, inverted abasic residues (invAb) (also referred to in the art as "inverted abasic sites") are added as capping residues. (See, e.g., F. Czauderna, Nucleic Acids Res., 2003, 31(11), 2705-16; U.S. Pat. No. 5,998,203). Capping residues are generally known in the art, and include, for example, inverted abasic residues as well as carbon chains such as a terminal C3H7 (propyl), C6H13 (hexyl), or C12H25 (dodecyl) groups. In some embodiments, a capping residue is present at either the 5' terminal end, the 3' terminal end, or both the 5' and 3' terminal ends of the sense strand. In some embodiments, the 5' end and/or the 3' end of the sense strand may include more than one inverted abasic deoxyribose moiety as a capping residue.

In some embodiments, one or more inverted abasic residues (invAb) are added to the 3' end of the sense strand. In some embodiments, one or more inverted abasic residues (invAb) are added to the 5' end of the sense strand. In some embodiments, one or more inverted abasic residues or inverted abasic sites are inserted between the targeting ligand and the nucleotide sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, one or more inverted abasic residues (invAb) are added to the 5' end of the sense strand. In some embodiments, one or more inverted abasic residues can be inserted between the targeting ligand and the nucleotide sequence of the sense strand of the RNAi agent. The inverted abasic residues may be linked via phosphate, phosphorothioate (e.g., shown herein as (invAb)s)), phosphorodithioate or other linkages. In some embodiments, the inclusion of one or more inverted abasic residues at or near the terminal end or terminal ends of the sense strand of an RNAi agent may allow for enhanced activity or other desired properties of an RNAi agent. In some embodiments, an inverted abasic (deoxyribose) residue can be replaced with an inverted ribitol (abasic ribose) residue. In some embodiments, the 3' end of the antisense strand core stretch sequence, or the 3' end of the antisense strand sequence, may include an inverted abasic residue. The chemical structures for inverted abasic deoxyribose residues are shown in Table 6 below.

INHBE RNAi Agents

The INHBE RNAi agents disclosed herein are designed to target specific positions on an INHBE gene (e.g., SEQ ID NO: 1).

NM_031479.5 *Homo sapiens* inhibin subunit beta E (INHBE), mRNA transcript (SEQ ID NO: 1):

```
   1  agtagccaga catgagctgt gagggtcaag cacagctatc catcagatga tctactttca
  61  gccttcctga gtcccagaca atagaagaca ggtggctgta cccttggcca agggtaggtg
 121  tggcagtggt gtctgctgtc actgtgccct cattggcccc cagcaatcag actcaacaga
 181  cggagcaact gccatccgag gctcctgaac cagggccatt caccaggagc atgcggctcc
 241  ctgatgtcca gctctggctg gtgctgctgt gggcactggt gcgagcacag gggacagggt
 301  ctgtgtgtcc ctcctgtggg ggctccaaac tggcacccca agcagaacga gctctggtgc
 361  tggagctagc caagcagcaa atcctggatg ggttgcacct gaccagtcgt cccagaataa
 421  ctcatcctcc accccaggca gcgctgacca gagccctccg gagactacag ccagggagtg
 481  tggctccagg gaatggggag gaggtcatca gctttgctac tgtcacagac tccacttcag
 541  cctacagctc cctgctcact tttcacctgt ccactcctcg gtcccaccac ctgtaccatg
 601  cccgcctgtg gctgcacgtg ctccccaccc ttcctggcac tctttgcttg aggatcttcc
 661  gatggggacc aaggaggagg cgccaagggt cccgcactct cctggctgag caccacatca
 721  ccaacctggg ctggcatacc ttaactctgc cctctagtgg cttgaggggt gagaagtctg
 781  gtgtcctgaa actgcaacta gactgcagac ccctagaagg caacagcaca gttactggac
 841  aaccgaggcg gctcttggac acagcaggac accagcagcc cttcctagag cttaagatcc
 901  gagccaatga gcctggagca ggccgggcca ggaggaggac ccccacctgt gagcctgcga
 961  ccccctttatg ttgcaggcga gaccattacg tagacttcca ggaactggga tggcgggact
```

-continued

```
1021  ggatactgca gcccgagggg taccagctga attactgcag tgggcagtgc cctccccacc

1081  tggctggcag cccaggcatt gctgcctctt tccattctgc cgtcttcagc ctcctcaaag

1141  ccaacaatcc ttggcctgcc agtacctcct gttgtgtccc tactgcccga aggcccctct

1201  ctctcctcta cctggatcat aatggcaatg tggtcaagac ggatgtgcca gatatggtgg

1261  tggaggcctg tggctgcagc tagcaagagg acctggggct ttggagtgaa gagaccaaga

1321  tgaagtttcc caggcacagg gcatctgtga ctggaggcat cagattcctg atccacaccc

1381  caacccaaca accacctggc aatatgactc acttgacccc tatgggaccc aaatgggcac

1441  tttcttgtct gagactctgg cttattccag gttggctgat gtgttgggag atgggtaaag

1501  cgtttcttct aaaggggtct acccagaaag catgatttcc tgccctaagt cctgtgagaa

1561  gatgtcaggg actagggagg gagggaggga aggcagagaa aaattactta gcctctccca

1621  agatgagaaa gtcctcaagt gaggggagga ggaagcagat agatggtcca gcaggcttga

1681  agcagggtaa gcaggctggc ccagggtaag ggctgttgag gtaccttaag ggaaggtcaa

1741  gagggagatg ggcaaggcgc tgagggagga tgcttagggg acccccagaa acaggagtca

1801  ggaaaatgag gcactaagcc taagaagttc cctggttttt cccaggggac aggacccact

1861  gggagacaag catttatact ttctttcttc ttttttattt ttttgagatc gagtctcgct

1921  ctgtcaccag gctggagtgc agtgacacga tcttggctca ctgcaacctc cgtctcctgg

1981  gttcaagtga ttcttctgcc tcagcctccc gagcagctgg gattacaggc gcccactaat

2041  ttttgtattc ttagtagaaa cgaggtttca acatgttggc caggatggtc tcaatctctt

2101  gacctcttga tccacccgac ttggcctccc gaagtgatga gattataggc gtgagccacc

2161  gcgcctggct tatactttct taataaaaag gagaaagaaa atcaacaaat gtgagtcata

2221  aagaagggtt agggtgatgg tccagagcaa cagttcttca agtgtactct gtaggcttct

2281  gggaggtccc ttttcagggg tgtccacaaa gtcaaagcta ttttcataat aatactaaca

2341  tgttatttgc cttttgaatt ctcattatct taaaattgta ttgtggagtt ttccagaggc

2401  cgtgtgacat gtgattacat catctttctg acatcattgt taatggaatg tgtgcttgta
```

As defined herein, an antisense strand sequence is designed to target an INHBE gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target an INHBE gene at position 1322 requires that when base pairing to the gene, the 5' terminal nucleobase of the antisense strand is aligned with position 1342 of the INHBE gene.

As provided herein, an INHBE RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for an INHBE RNAi agent disclosed herein that is designed to target position 402 of an INHBE gene, the 5' terminal nucleobase of the antisense strand of the of the INHBE RNAi agent is aligned with position 422 of the gene; however, the 5' terminal nucleobase of the antisense strand may be, but is not required to be, complementary to position 422 of an INHBE gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. As shown by, among other things, the various examples disclosed herein, the specific site of binding of the gene by the antisense strand of the INHBE RNAi agent (e.g., whether the INHBE RNAi agent is designed to target an INHBE gene at position 402, at position 520, or at some other position) is important to the level of inhibition achieved by the INHBE RNAi agent.

In some embodiments, the INHBE RNAi agents disclosed herein target an INHBE gene at or near the positions of the INHBE gene sequence shown in Table 1. In some embodiments, the antisense strand of an INHBE RNAi agent disclosed herein includes a core stretch sequence that is fully, substantially, or at least partially complementary to a target INHBE 19-mer sequence disclosed in Table 1.

TABLE 1

INHBE 19-mer mRNA Target Sequences (taken from *homo sapiens* inhibin subunit beta E (INHBE), mRNA, GenBank NM_031479.5 (SEQ ID NO: 1))

| SEQ ID No. | INHBE 19-mer Target Sequences (5'→3') | Corresponding Positions of Sequence on SEQ ID NO: 1 | Targeted Gene Position (as referred to herein) |
|---|---|---|---|
| 2 | CAGUCGUCCCAGAAUAACU | 404-422 | 402 |
| 3 | GUCACAGACUCCACUUCAG | 522-540 | 520 |
| 4 | CCACUUCAGCCUACAGCUC | 532-550 | 530 |
| 5 | GGCACUCUUUGCUUGAGGA | 636-654 | 634 |
| 6 | ACUCUUUGCUUGAGGAUCU | 639-657 | 637 |
| 7 | UGCUUGAGGAUCUUCCGAU | 645-663 | 643 |
| 8 | CACCACAUCACCAACCUGG | 711-729 | 709 |
| 9 | UCCUGAAACUGCAACUAGA | 784-802 | 782 |
| 10 | CCUGAAACUGCAACUAGAC | 785-803 | 783 |
| 11 | UUCCUAGAGCUUAAGAUCC | 882-900 | 880 |
| 12 | CUAGAGCUUAAGAUCCGAG | 885-903 | 883 |
| 13 | GGUACCAGCUGAAUUACUG | 1039-1057 | 1037 |
| 14 | UACCAGCUGAAUUACUGCA | 1041-1059 | 1039 |
| 15 | GCUGCCUCUUUCCAUUCUG | 1101-1119 | 1099 |
| 16 | CUGCCUCUUUCCAUUCUGC | 1102-1120 | 1100 |
| 17 | UCCUCUACCUGGAUCAUAA | 1204-1222 | 1202 |
| 18 | AUAAUGGCAAUGUGGUCAA | 1219-1237 | 1217 |
| 19 | AAUGGCAAUGUGGUCAAGA | 1221-1239 | 1219 |
| 20 | AGUGAAGAGACCAAGAUGA | 1305-1323 | 1303 |
| 21 | ACUGGAGGCAUCAGAUUCC | 1350-1368 | 1348 |
| 22 | CCACCUGGCAAUAUGACUC | 1392-1410 | 1390 |
| 23 | UGGCAAUAUGACUCACUUG | 1397-1415 | 1395 |
| 24 | ACUCACUUGACCCCUAUGG | 1407-1425 | 1405 |
| 25 | ACCCAAAUGGGCACUUUCU | 1427-1445 | 1425 |
| 26 | CAAAUGGGCACUUUCUUGU | 1430-1448 | 1428 |
| 27 | AAUGGGCACUUUCUUGUCU | 1432-1450 | 1430 |
| 28 | CAGGUUGGCUGAUGUGUUG | 1468-1486 | 1466 |
| 29 | GGAGGAAGCAGAUAGAUGG | 1648-1666 | 1646 |
| 30 | GCUUGAAGCAGGGUAAGCA | 1675-1693 | 1673 |
| 31 | CUUGAAGCAGGGUAAGCAG | 1676-1694 | 1674 |
| 32 | ACUAAGCCUAAGAAGUUCC | 1813-1831 | 1811 |
| 33 | CUGGGAGACAAGCAUUUAU | 1859-1877 | 1857 |
| 34 | GAGACAAGCAUUUAUACUU | 1863-1881 | 1861 |
| 35 | AGACAAGCAUUUAUACUUU | 1864-1882 | 1862 |
| 36 | CCUGGCUUAUACUUUCUUA | 2164-2182 | 2162 |

TABLE 1-continued

| INHBE 19-mer mRNA Target Sequences (taken from *homo sapiens* inhibin subunit beta E (INHBE), mRNA, GenBank NM_031479.5 (SEQ ID NO: 1)) | | | |
|---|---|---|---|
| SEQ ID No. | INHBE 19-mer Target Sequences (5'→3') | Corresponding Positions of Sequence on SEQ ID NO: 1 | Targeted Gene Position (as referred to herein) |
| 37 | CUGGCUUAUACUUUCUUAA | 2165-2183 | 2163 |
| 38 | GGCUUAUACUUUCUUAAUA | 2167-2185 | 2165 |

In some embodiments, an INHBE RNAi agent includes an antisense strand wherein position 19 of the antisense strand (5'→3') is capable of forming a base pair with position 1 of a 19-mer target sequence disclosed in Table 1. In some embodiments, an INHBE RNAi agent includes an antisense strand wherein position 1 of the antisense strand (5'→3') is capable of forming a base pair with position 19 of the 19-mer target sequence disclosed in Table 1.

In some embodiments, an INHBE RNAi agent includes an antisense strand wherein position 2 of the antisense strand (5' 4→3') is capable of forming a base pair with position 18 of the 19-mer target sequence disclosed in Table 1. In some embodiments, an INHBE RNAi agent includes an antisense strand wherein positions 2 through 18 of the antisense strand (5' 4→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to the INHBE gene, or can be non-complementary to the INHBE gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, an INHBE RNAi agent antisense strand comprises the sequence of nucleotides (from 5' end→3' end) at positions 2-18, 2-19, 2-20, or 2-21 of any of the antisense strand sequences in Table 2, Table 3, or Table 5C. In some embodiments, an INHBE RNAi sense strand comprises the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences in Table 2, Table 4, or Table 5C.

In some embodiments, an INHBE RNAi agent antisense strand comprises the sequence of nucleotides (from 5' end→3' end) at positions 2-18, 2-19, 2-20, or 2-21 of any of the antisense strand sequences of Table 2, Table 3, or Table 5C. In some embodiments, an INHBE RNAi sense strand comprises the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences of Table 2, Table 4, or Table 5C.

In some embodiments, an INHBE RNAi agent is comprised of (i) an antisense strand comprising the sequence of nucleotides (from 5' end→3' end) at positions 2-18 or 2-19 of any of the antisense strand sequences in Table 2 or Table 3, and (ii) a sense strand comprising the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences in Table 2 or Table 4.

In some embodiments, the INHBE RNAi agents include core 19-mer nucleotide sequences shown in the following Table 2.

TABLE 2

| INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide) | | | | | | |
|---|---|---|---|---|---|---|
| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
| 39 | AGUUAUUCUGGGACGACUG | 204 | CAGUCGUCCCAGAAUAACU | 404-422 | 402 |
| 40 | UGUUAUUCUGGGACGACUG | 205 | CAGUCGUCCCAGAAUAACA | 404-422 | 402 |
| 41 | NGUUAUUCUGGGACGACUG | 206 | CAGUCGUCCCAGAAUAACN | 404-422 | 402 |
| 42 | NGUUAUUCUGGGACGACUN | 207 | NAGUCGUCCCAGAAUAACN | 404-422 | 402 |
| 43 | CUGAAGUGGAGUCUGUGAC | 208 | GUCACAGACUCCACUUCAG | 522-540 | 520 |
| 44 | UUGAAGUGGAGUCUGUGAC | 209 | GUCACAGACUCCACUUCAA | 522-540 | 520 |
| 45 | AUGAAGUGGAGUCUGUGAC | 210 | GUCACAGACUCCACUUCAU | 522-540 | 520 |
| 46 | NUGAAGUGGAGUCUGUGAC | 211 | GUCACAGACUCCACUUCAN | 522-540 | 520 |
| 47 | NUGAAGUGGAGUCUGUGAN | 212 | NUCACAGACUCCACUUCAN | 522-540 | 520 |
| 48 | GAGCUGUAGGCUGAAGUGG | 213 | CCACUUCAGCCUACAGCUC | 532-550 | 530 |

TABLE 2-continued

INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide)

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 49 | UAGCUGUAGGCUGAAGUGG | 214 | CCACUUCAGCCUACAGCUA | 532-550 | 530 |
| 50 | AAGCUGUAGGCUGAAGUGG | 215 | CCACUUCAGCCUACAGCUU | 532-550 | 530 |
| 51 | NAGCUGUAGGCUGAAGUGG | 216 | CCACUUCAGCCUACAGCUN | 532-550 | 530 |
| 52 | NAGCUGUAGGCUGAAGUGN | 217 | NCACUUCAGCCUACAGCUN | 532-550 | 530 |
| 53 | UCCUCAAGCAAAGAGUGCC | 218 | GGCACUCUUUGCUUGAGGA | 636-654 | 634 |
| 54 | ACCUCAAGCAAAGAGUGCC | 219 | GGCACUCUUUGCUUGAGGU | 636-654 | 634 |
| 55 | NCCUCAAGCAAAGAGUGCC | 220 | GGCACUCUUUGCUUGAGGN | 636-654 | 634 |
| 56 | NCCUCAAGCAAAGAGUGCN | 221 | NGCACUCUUUGCUUGAGGN | 636-654 | 634 |
| 57 | AGAUCCUCAAGCAAAGAGU | 222 | ACUCUUUGCUUGAGGAUCU | 639-657 | 637 |
| 58 | UGAUCCUCAAGCAAAGAGU | 223 | ACUCUUUGCUUGAGGAUCA | 639-657 | 637 |
| 59 | NGAUCCUCAAGCAAAGAGU | 224 | ACUCUUUGCUUGAGGAUCN | 639-657 | 637 |
| 60 | NGAUCCUCAAGCAAAGAGN | 225 | NCUCUUUGCUUGAGGAUCN | 639-657 | 637 |
| 61 | AUCGGAAGAUCCUCAAGCA | 226 | UGCUUGAGGAUCUUCCGAU | 645-663 | 643 |
| 62 | UUCGGAAGAUCCUCAAGCA | 227 | UGCUUGAGGAUCUUCCGAA | 645-663 | 643 |
| 63 | NUCGGAAGAUCCUCAAGCA | 228 | UGCUUGAGGAUCUUCCGAN | 645-663 | 643 |
| 64 | NUCGGAAGAUCCUCAAGCN | 229 | NGCUUGAGGAUCUUCCGAN | 645-663 | 643 |
| 65 | CCAGGUUGGUGAUGUGGUG | 230 | CACCACAUCACCAACCUGG | 711-729 | 709 |
| 66 | UCAGGUUGGUGAUGUGGUG | 231 | CACCACAUCACCAACCUGA | 711-729 | 709 |
| 67 | ACAGGUUGGUGAUGUGGUG | 232 | CACCACAUCACCAACCUGU | 711-729 | 709 |
| 68 | NCAGGUUGGUGAUGUGGUG | 233 | CACCACAUCACCAACCUGN | 711-729 | 709 |
| 69 | NCAGGUUGGUGAUGUGGUN | 234 | NACCACAUCACCAACCUGN | 711-729 | 709 |
| 70 | UCUAGUUGCAGUUUCAGGA | 235 | UCCUGAAACUGCAACUAGA | 784-802 | 782 |
| 71 | ACUAGUUGCAGUUUCAGGA | 236 | UCCUGAAACUGCAACUAGU | 784-802 | 782 |
| 72 | NCUAGUUGCAGUUUCAGGA | 237 | UCCUGAAACUGCAACUAGN | 784-802 | 782 |
| 73 | NCUAGUUGCAGUUUCAGGN | 238 | NCCUGAAACUGCAACUAGN | 784-802 | 782 |
| 74 | GUCUAGUUGCAGUUUCAGG | 239 | CCUGAAACUGCAACUAGAC | 785-803 | 783 |
| 75 | UUCUAGUUGCAGUUUCAGG | 240 | CCUGAAACUGCAACUAGAA | 785-803 | 783 |
| 76 | AUCUAGUUGCAGUUUCAGG | 241 | CCUGAAACUGCAACUAGAU | 785-803 | 783 |
| 77 | NUCUAGUUGCAGUUUCAGG | 242 | CCUGAAACUGCAACUAGAN | 785-803 | 783 |
| 78 | NUCUAGUUGCAGUUUCAGN | 243 | NCUGAAACUGCAACUAGAN | 785-803 | 783 |
| 79 | GGAUCUUAAGCUCUAGGAA | 244 | UUCCUAGAGCUUAAGAUCC | 882-900 | 880 |
| 80 | AGAUCUUAAGCUCUAGGAA | 245 | UUCCUAGAGCUUAAGAUCU | 882-900 | 880 |
| 81 | UGAUCUUAAGCUCUAGGAA | 246 | UUCCUAGAGCUUAAGAUCA | 882-900 | 880 |
| 82 | NGAUCUUAAGCUCUAGGAA | 247 | UUCCUAGAGCUUAAGAUCN | 882-900 | 880 |
| 83 | NGAUCUUAAGCUCUAGGAN | 248 | NUCCUAGAGCUUAAGAUCN | 882-900 | 880 |

TABLE 2-continued

INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide)

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 84 | CUCGGAUCUUAAGCUCUAG | 249 | CUAGAGCUUAAGAUCCGAG | 885-903 | 883 |
| 85 | UUCGGAUCUUAAGCUCUAG | 250 | CUAGAGCUUAAGAUCCGAA | 885-903 | 883 |
| 86 | AUCGGAUCUUAAGCUCUAG | 251 | CUAGAGCUUAAGAUCCGAU | 885-903 | 883 |
| 87 | NUCGGAUCUUAAGCUCUAG | 252 | CUAGAGCUUAAGAUCCGAN | 885-903 | 883 |
| 88 | NUCGGAUCUUAAGCUCUAN | 253 | NUAGAGCUUAAGAUCCGAN | 885-903 | 883 |
| 89 | CAGUAAUUCAGCUGGUACC | 254 | GGUACCAGCUGAAUUACUG | 1039-1057 | 1037 |
| 90 | AAGUAAUUCAGCUGGUACC | 255 | GGUACCAGCUGAAUUACUU | 1039-1057 | 1037 |
| 91 | UAGUAAUUCAGCUGGUACC | 256 | GGUACCAGCUGAAUUACUA | 1039-1057 | 1037 |
| 92 | NAGUAAUUCAGCUGGUACC | 257 | GGUACCAGCUGAAUUACUN | 1039-1057 | 1037 |
| 93 | NAGUAAUUCAGCUGGUACN | 258 | NGUACCAGCUGAAUUACUN | 1039-1057 | 1037 |
| 94 | UGCAGUAAUUCAGCUGGUA | 259 | UACCAGCUGAAUUACUGCA | 1041-1059 | 1039 |
| 95 | AGCAGUAAUUCAGCUGGUA | 260 | UACCAGCUGAAUUACUGCU | 1041-1059 | 1039 |
| 96 | NGCAGUAAUUCAGCUGGUA | 261 | UACCAGCUGAAUUACUGCN | 1041-1059 | 1039 |
| 97 | NGCAGUAAUUCAGCUGGUN | 262 | NACCAGCUGAAUUACUGCN | 1041-1059 | 1039 |
| 98 | CAGAAUGGAAAGAGGCAGC | 263 | GCUGCCUCUUUCCAUUCUG | 1101-1119 | 1099 |
| 99 | AAGAAUGGAAAGAGGCAGC | 264 | GCUGCCUCUUUCCAUUCUU | 1101-1119 | 1099 |
| 100 | UAGAAUGGAAAGAGGCAGC | 265 | GCUGCCUCUUUCCAUUCUA | 1101-1119 | 1099 |
| 101 | NAGAAUGGAAAGAGGCAGC | 266 | GCUGCCUCUUUCCAUUCUN | 1101-1119 | 1099 |
| 102 | NAGAAUGGAAAGAGGCAGN | 267 | NCUGCCUCUUUCCAUUCUN | 1101-1119 | 1099 |
| 103 | GCAGAAUGGAAAGAGGCAG | 268 | CUGCCUCUUUCCAUUCUGC | 1102-1120 | 1100 |
| 104 | UCAGAAUGGAAAGAGGCAG | 269 | CUGCCUCUUUCCAUUCUGA | 1102-1120 | 1100 |
| 105 | ACAGAAUGGAAAGAGGCAG | 270 | CUGCCUCUUUCCAUUCUGU | 1102-1120 | 1100 |
| 106 | NCAGAAUGGAAAGAGGCAG | 271 | CUGCCUCUUUCCAUUCUGN | 1102-1120 | 1100 |
| 107 | NCAGAAUGGAAAGAGGCAN | 272 | NUGCCUCUUUCCAUUCUGN | 1102-1120 | 1100 |
| 108 | UUAUGAUCCAGGUAGAGGA | 273 | UCCUCUACCUGGAUCAUAA | 1204-1222 | 1202 |
| 109 | AUAUGAUCCAGGUAGAGGA | 274 | UCCUCUACCUGGAUCAUAU | 1204-1222 | 1202 |
| 110 | NUAUGAUCCAGGUAGAGGA | 275 | UCCUCUACCUGGAUCAUAN | 1204-1222 | 1202 |
| 111 | NUAUGAUCCAGGUAGAGGN | 276 | NCCUCUACCUGGAUCAUAN | 1204-1222 | 1202 |
| 112 | UUGACCACAUUGCCAUUAU | 277 | AUAAUGGCAAUGUGGUCAA | 1219-1237 | 1217 |
| 113 | AUGACCACAUUGCCAUUAU | 278 | AUAAUGGCAAUGUGGUCAU | 1219-1237 | 1217 |
| 114 | NUGACCACAUUGCCAUUAU | 279 | AUAAUGGCAAUGUGGUCAN | 1219-1237 | 1217 |
| 115 | NUGACCACAUUGCCAUUAN | 280 | NUAAUGGCAAUGUGGUCAN | 1219-1237 | 1217 |
| 116 | UCUUGACCACAUUGCCAUU | 281 | AAUGGCAAUGUGGUCAAGA | 1221-1239 | 1219 |
| 117 | ACUUGACCACAUUGCCAUU | 282 | AAUGGCAAUGUGGUCAAGU | 1221-1239 | 1219 |
| 118 | NCUUGACCACAUUGCCAUU | 283 | AAUGGCAAUGUGGUCAAGN | 1221-1239 | 1219 |
| 119 | NCUUGACCACAUUGCCAUN | 284 | NAUGGCAAUGUGGUCAAGN | 1221-1239 | 1219 |

TABLE 2-continued

INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide)

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 120 | UCAUCUUGGUCUCUUCACU | 285 | AGUGAAGAGACCAAGAUGA | 1305-1323 | 1303 |
| 121 | ACAUCUUGGUCUCUUCACU | 286 | AGUGAAGAGACCAAGAUGU | 1305-1323 | 1303 |
| 122 | NCAUCUUGGUCUCUUCACU | 287 | AGUGAAGAGACCAAGAUGN | 1305-1323 | 1303 |
| 123 | NCAUCUUGGUCUCUUCACN | 288 | NGUGAAGAGACCAAGAUGN | 1305-1323 | 1303 |
| 124 | GGAAUCUGAUGCCUCCAGU | 289 | ACUGGAGGCAUCAGAUUCC | 1350-1368 | 1348 |
| 125 | AGAAUCUGAUGCCUCCAGU | 290 | ACUGGAGGCAUCAGAUUCU | 1350-1368 | 1348 |
| 126 | UGAAUCUGAUGCCUCCAGU | 291 | ACUGGAGGCAUCAGAUUCA | 1350-1368 | 1348 |
| 127 | NGAAUCUGAUGCCUCCAGU | 292 | ACUGGAGGCAUCAGAUUCN | 1350-1368 | 1348 |
| 128 | NGAAUCUGAUGCCUCCAGN | 293 | NCUGGAGGCAUCAGAUUCN | 1350-1368 | 1348 |
| 129 | GAGUCAUAUUGCCAGGUGG | 294 | CCACCUGGCAAUAUGACUC | 1392-1410 | 1390 |
| 130 | AAGUCAUAUUGCCAGGUGG | 295 | CCACCUGGCAAUAUGACUU | 1392-1410 | 1390 |
| 131 | UAGUCAUAUUGCCAGGUGG | 296 | CCACCUGGCAAUAUGACUA | 1392-1410 | 1390 |
| 132 | NAGUCAUAUUGCCAGGUGG | 297 | CCACCUGGCAAUAUGACUN | 1392-1410 | 1390 |
| 133 | NAGUCAUAUUGCCAGGUGN | 298 | NCACCUGGCAAUAUGACUN | 1392-1410 | 1390 |
| 134 | CAAGUGAGUCAUAUUGCCA | 299 | UGGCAAUAUGACUCACUUG | 1397-1415 | 1395 |
| 135 | UAAGUGAGUCAUAUUGCCA | 300 | UGGCAAUAUGACUCACUUA | 1397-1415 | 1395 |
| 136 | AAAGUGAGUCAUAUUGCCA | 301 | UGGCAAUAUGACUCACUUU | 1397-1415 | 1395 |
| 137 | NAAGUGAGUCAUAUUGCCA | 302 | UGGCAAUAUGACUCACUUN | 1397-1415 | 1395 |
| 138 | NAAGUGAGUCAUAUUGCCN | 303 | NGGCAAUAUGACUCACUUN | 1397-1415 | 1395 |
| 139 | CCAUAGGGGUCAAGUGAGU | 304 | ACUCACUUGACCCCUAUGG | 1407-1425 | 1405 |
| 140 | ACAUAGGGGUCAAGUGAGU | 305 | ACUCACUUGACCCCUAUGU | 1407-1425 | 1405 |
| 141 | UCAUAGGGGUCAAGUGAGU | 306 | ACUCACUUGACCCCUAUGA | 1407-1425 | 1405 |
| 142 | NCAUAGGGGUCAAGUGAGU | 307 | ACUCACUUGACCCCUAUGN | 1407-1425 | 1405 |
| 143 | NCAUAGGGGUCAAGUGAGN | 308 | NCUCACUUGACCCCUAUGN | 1407-1425 | 1405 |
| 144 | AGAAAGUGCCCAUUUGGGU | 309 | ACCCAAAUGGGCACUUUCU | 1427-1445 | 1425 |
| 145 | UGAAAGUGCCCAUUUGGGU | 310 | ACCCAAAUGGGCACUUUCA | 1427-1445 | 1425 |
| 146 | NGAAAGUGCCCAUUUGGGU | 311 | ACCCAAAUGGGCACUUUCN | 1427-1445 | 1425 |
| 147 | NGAAAGUGCCCAUUUGGGN | 312 | NCCCAAAUGGGCACUUUCN | 1427-1445 | 1425 |
| 148 | ACAAGAAAGUGCCCAUUUG | 313 | CAAAUGGGCACUUUCUUGU | 1430-1448 | 1428 |
| 149 | UCAAGAAAGUGCCCAUUUG | 314 | CAAAUGGGCACUUUCUUGA | 1430-1448 | 1428 |
| 150 | NCAAGAAAGUGCCCAUUUG | 315 | CAAAUGGGCACUUUCUUGN | 1430-1448 | 1428 |
| 151 | NCAAGAAAGUGCCCAUUUN | 316 | NAAAUGGGCACUUUCUUGN | 1430-1448 | 1428 |
| 152 | UGACAAGAAAGUGCCCAUU | 317 | AAUGGGCACUUUCUUGUCU | 1432-1450 | 1430 |
| 153 | AGACAAGAAAGUGCCCAUU | 318 | AAUGGGCACUUUCUUGUCA | 1432-1450 | 1430 |
| 154 | NGACAAGAAAGUGCCCAUU | 319 | AAUGGGCACUUUCUUGUCN | 1432-1450 | 1430 |

TABLE 2-continued

INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide)

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 155 | NGACAAGAAAGUGCCCAUN | 320 | NAUGGGCACUUUCUUGUCN | 1432-1450 | 1430 |
| 156 | CAACACAUCAGCCAACCUG | 321 | CAGGUUGGCUGAUGUGUUG | 1468-1486 | 1466 |
| 157 | AAACACAUCAGCCAACCUG | 322 | CAGGUUGGCUGAUGUGUUU | 1468-1486 | 1466 |
| 158 | UAACACAUCAGCCAACCUG | 323 | CAGGUUGGCUGAUGUGUUA | 1468-1486 | 1466 |
| 159 | NAACACAUCAGCCAACCUG | 324 | CAGGUUGGCUGAUGUGUUN | 1468-1486 | 1466 |
| 160 | NAACACAUCAGCCAACCUN | 325 | NAGGUUGGCUGAUGUGUUN | 1468-1486 | 1466 |
| 161 | CCAUCUAUCUGCUUCCUCC | 326 | GGAGGAAGCAGAUAGAUGG | 1648-1666 | 1646 |
| 162 | UCAUCUAUCUGCUUCCUCC | 327 | GGAGGAAGCAGAUAGAUGA | 1648-1666 | 1646 |
| 163 | ACAUCUAUCUGCUUCCUCC | 328 | GGAGGAAGCAGAUAGAUGU | 1648-1666 | 1646 |
| 164 | NCAUCUAUCUGCUUCCUCC | 329 | GGAGGAAGCAGAUAGAUGN | 1648-1666 | 1646 |
| 165 | NCAUCUAUCUGCUUCCUCN | 330 | NGAGGAAGCAGAUAGAUGN | 1648-1666 | 1646 |
| 166 | UGCUUACCCUGCUUCAAGC | 331 | GCUUGAAGCAGGGUAAGCA | 1675-1693 | 1673 |
| 167 | AGCUUACCCUGCUUCAAGC | 332 | GCUUGAAGCAGGGUAAGCU | 1675-1693 | 1673 |
| 168 | NGCUUACCCUGCUUCAAGC | 333 | GCUUGAAGCAGGGUAAGCN | 1675-1693 | 1673 |
| 169 | NGCUUACCCUGCUUCAAGN | 334 | NCUUGAAGCAGGGUAAGCN | 1675-1693 | 1673 |
| 170 | CUGCUUACCCUGCUUCAAG | 335 | CUUGAAGCAGGGUAAGCAG | 1676-1694 | 1674 |
| 171 | AUGCUUACCCUGCUUCAAG | 336 | CUUGAAGCAGGGUAAGCAU | 1676-1694 | 1674 |
| 172 | UUGCUUACCCUGCUUCAAG | 337 | CUUGAAGCAGGGUAAGCAA | 1676-1694 | 1674 |
| 173 | NUGCUUACCCUGCUUCAAG | 338 | CUUGAAGCAGGGUAAGCAN | 1676-1694 | 1674 |
| 174 | NUGCUUACCCUGCUUCAAN | 339 | NUUGAAGCAGGGUAAGCAN | 1676-1694 | 1674 |
| 175 | GGAACUUCUUAGGCUUAGU | 340 | ACUAAGCCUAAGAAGUUCC | 1813-1831 | 1811 |
| 176 | UGAACUUCUUAGGCUUAGU | 341 | ACUAAGCCUAAGAAGUUCA | 1813-1831 | 1811 |
| 177 | AGAACUUCUUAGGCUUAGU | 342 | ACUAAGCCUAAGAAGUUCU | 1813-1831 | 1811 |
| 178 | NGAACUUCUUAGGCUUAGU | 343 | ACUAAGCCUAAGAAGUUCN | 1813-1831 | 1811 |
| 179 | NGAACUUCUUAGGCUUAGN | 344 | NCUAAGCCUAAGAAGUUCN | 1813-1831 | 1811 |
| 180 | AUAAAUGCUUGUCUCCCAG | 345 | CUGGGAGACAAGCAUUUAU | 1859-1877 | 1857 |
| 181 | UUAAAUGCUUGUCUCCCAG | 346 | CUGGGAGACAAGCAUUUAA | 1859-1877 | 1857 |
| 182 | NUAAAUGCUUGUCUCCCAG | 347 | CUGGGAGACAAGCAUUUAN | 1859-1877 | 1857 |
| 183 | NUAAAUGCUUGUCUCCCAN | 348 | NUGGGAGACAAGCAUUUAN | 1859-1877 | 1857 |
| 184 | AAGUAUAAAUGCUUGUCUC | 349 | GAGACAAGCAUUUAUACUU | 1863-1881 | 1861 |
| 185 | UAGUAUAAAUGCUUGUCUC | 350 | GAGACAAGCAUUUAUACUA | 1863-1881 | 1861 |
| 186 | NAGUAUAAAUGCUUGUCUC | 351 | GAGACAAGCAUUUAUACUN | 1863-1881 | 1861 |
| 187 | NAGUAUAAAUGCUUGUCUN | 352 | NAGACAAGCAUUUAUACUN | 1863-1881 | 1861 |
| 188 | AAAGUAUAAAUGCUUGUCU | 353 | AGACAAGCAUUUAUACUUU | 1864-1882 | 1862 |
| 189 | UAAGUAUAAAUGCUUGUCU | 354 | AGACAAGCAUUUAUACUUA | 1864-1882 | 1862 |
| 190 | NAAGUAUAAAUGCUUGUCU | 355 | AGACAAGCAUUUAUACUUN | 1864-1882 | 1862 |

TABLE 2-continued

INHBE RNAi Agent Antisense Strand and Sense Strand Core Stretch Base Sequences (N = any nucleobase; I = hypoxanthine (inosine nucleotide); ($A^{2N}$) = 2-aminoadenine nucleotide)

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 191 | NAAGUAUAAAUGCUUGUCN | 356 | NGACAAGCAUUUAUACUUN | 1864-1882 | 1862 |
| 192 | UAAGAAAGUAUAAGCCAGG | 357 | CCUGGCUUAUACUUUCUUA | 2164-2182 | 2162 |
| 193 | AAAGAAAGUAUAAGCCAGG | 358 | CCUGGCUUAUACUUUCUUU | 2164-2182 | 2162 |
| 194 | NAAGAAAGUAUAAGCCAGG | 359 | CCUGGCUUAUACUUUCUUN | 2164-2182 | 2162 |
| 195 | NAAGAAAGUAUAAGCCAGN | 360 | NCUGGCUUAUACUUUCUUN | 2164-2182 | 2162 |
| 196 | UUAAGAAAGUAUAAGCCAG | 361 | CUGGCUUAUACUUUCUUAA | 2165-2183 | 2163 |
| 197 | AUAAGAAAGUAUAAGCCAG | 362 | CUGGCUUAUACUUUCUUAU | 2165-2183 | 2163 |
| 198 | NUAAGAAAGUAUAAGCCAG | 363 | CUGGCUUAUACUUUCUUAN | 2165-2183 | 2163 |
| 199 | NUAAGAAAGUAUAAGCCAN | 364 | NUGGCUUAUACUUUCUUAN | 2165-2183 | 2163 |
| 200 | UAUUAAGAAAGUAUAAGCC | 365 | GGCUUAUACUUUCUUAAUA | 2167-2185 | 2165 |
| 201 | AAUUAAGAAAGUAUAAGCC | 366 | GGCUUAUACUUUCUUAAUU | 2167-2185 | 2165 |
| 202 | NAUUAAGAAAGUAUAAGCC | 367 | GGCUUAUACUUUCUUAAUN | 2167-2185 | 2165 |
| 203 | NAUUAAGAAAGUAUAAGCN | 368 | NGCUUAUACUUUCUUAAUN | 2167-2185 | 2165 |

The INHBE RNAi agent sense strands and antisense strands that comprise or consist of the sequences in Table 2 can be modified nucleotides or unmodified nucleotides. In some embodiments, the INHBE RNAi agents having the sense and antisense strand sequences that comprise or consist of the sequences in Table 2 are all or substantially all modified nucleotides.

In some embodiments, the antisense strand of an INHBE RNAi agent disclosed herein differs by 0, 1, 2, or 3 nucleotides from any of the antisense strand sequences in Table 2. In some embodiments, the sense strand of an INHBE RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified INHBE RNAi agent antisense strands, as well as their underlying unmodified nucleobase sequences, are provided in Table 3. Certain modified INHBE RNAi agent sense strands, as well as their underlying unmodified nucleobase sequences, are provided in Table 4. In forming INHBE RNAi agents, each of the nucleotides in each of the underlying base sequences listed in Tables 3 and 4, as well as in Table 2, above, can be a modified nucleotide.

The INHBE RNAi agents described herein are formed by annealing an antisense strand with a sense strand. A sense strand containing a sequence listed in Table 2 or Table 4, can be hybridized to any antisense strand containing a sequence listed in Table 2 or Table 3, provided the two sequences have a region of at least 85% complementarity over a contiguous 16, 17, 18, 19, 20, or 21 nucleotide sequence.

In some embodiments, an INHBE RNAi agent antisense strand comprises a nucleotide sequence of any of the sequences in Table 2 or Table 3.

In some embodiments, an INHBE RNAi agent comprises or consists of a duplex having the nucleobase sequences of the sense strand and the antisense strand of any of the sequences in Table 2, Table 3, or Table 4.

Examples of antisense strands containing modified nucleotides are provided in Table 3 and Table 5C. Examples of sense strands containing modified nucleotides are provided in Table 4 and Table 5C.

As used in Tables 3, 4, and 5C the following notations are used to indicate modified nucleotides and linking groups:

A=adenosine-3'-phosphate;
C=cytidine-3'-phosphate;
G=guanosine-3'-phosphate;
U=uridine-3'-phosphate
I=inosine-3'-phosphate
a=2'-O-methyladenosine-3'-phosphate
as =2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate gs=2'-O-methylguanosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
i=2'-O-methylinosine-3'-phosphate
is=2'-O-methylinosine-3'-phosphorothioate
iss=2'-O-methylinosine-3'-phosphorodithioate
Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
AUNA=2',3'-seco-adenosine-3'-phosphate (see Table 6)
AUNAS=2',3'-seco-adenosine-3'-phosphorothioate (see Table 6)
CUNA=2',3'-seco-cytidine-3'-phosphate (see Table 6)
CUNAS=2',3'-seco-cytidine-3'-phosphorothioate (see Table 6)
GUNA=2',3'-seco-guanosine-3'-phosphate (see Table 6)
GUNAS=2',3'-seco-guanosine-3'-phosphorothioate (see Table 6)
UUNA=2',3'-seco-uridine-3'-phosphate (see Table 6)
UUNAS=2',3'-seco-uridine-3'-phosphorothioate (see Table 6)
a_2N=2'-O-methyl-2-aminoadenosine-3'-phosphate (see Table 6)
a_2Ns=2'-O-methyl-2-aminoadenosine-3'-phosphorothioate (see Table 6)
(invAb)=inverted abasic deoxyribonucleotide (see Table 6)
(invAb)s=inverted abasic deoxyribonucleotide-5'-phosphorothioate (see Table 6)
cPrpa=5'-cyclopropyl phosphonate-2'-O-methyladenosine-3'-phosphate (see Table 6)
cPrpas=5'-cyclopropyl phosphonate-2'-O-methyladenosine-3'-phosphorothioate (see Table 6)
cPrpu=5'-cyclopropyl phosphonate-2'-O-methyluridine-3'-phosphate (see Table 6)
cPrpus=5'-cyclopropyl phosphonate-2'-O-methyluridine-3'-phosphorothioate (see Table 6)
dT=2'-deoxythymidine-3'-phosphate
dTs=2'-deoxythymidine-3'-phosphorothioate
dTss=2'-deoxythymidine-3'-phosphorodithioate
dU=2'-deoxyuridine-3'-phosphate
dUs=2'-deoxyuridine-3'-phosphorothioate
dUss=2'-deoxyuridine-3'-phosphorodithioate
dC=2'-deoxycytidine-3'-phosphate
dCs=2'-deoxycytidine-3'-phosphorothioate
dG=2'-deoxyguanosine-3'-phosphate
dGs=2'-deoxyguanosine-3'-phosphorothioate
dA=2'-deoxyadenosine-3'-phosphate
dAs=2'-deoxyadenosine-3'-phosphorothioate
dAss=2'-deoxyadenosine-3'-phosphorodithioate
(NAG37)=see Table 6
(NAG37)s=see Table 6

As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate or phosphorodithioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the various embodiments disclosed herein, when viewing the respective strand 5'→3', the inverted abasic residues are inserted such that the 3' position of the deoxyribose is linked at the 3' end of the preceding monomer on the respective strand (see, e.g., Table 6). Moreover, as the person of ordinary skill would readily understand and appreciate, while the phosphorothioate chemical structures depicted herein typically show the anion on the sulfur atom, the inventions disclosed herein encompass all phosphorothioate tautomers and resonance structures (e.g., where the sulfur atom has a double-bond and the anion is on an oxygen atom). Unless expressly indicated otherwise herein, such understandings of the person of ordinary skill in the art are used when describing the INHBE RNAi agents and compositions of INHBE RNAi agents disclosed herein.

Certain examples of targeting ligands, targeting groups, and linking groups used with the INHBE RNAi agents disclosed herein are provided below in Table 6. More specifically, targeting groups and linking groups (which together can form a targeting ligand) include (NAG37) and (NAG37)s, for which their chemical structures are provided below in Table 6. Each sense strand and/or antisense strand can have any targeting ligands, targeting groups, or linking groups listed herein, as well as other groups, conjugated to the 5' and/or 3' end of the sequence.

TABLE 3

INHBE RNAi Agent Antisense Strand Sequences

| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA004695 | asGfsuuauUfcuggGfaCfgAfcugsgsu | 369 | AGUUAUUCUGGGACGACUGGU | 609 |
| CA004697 | usGfsuuauUfcuggGfaCfgAfcugsgsu | 370 | UGUUAUUCUGGGACGACUGGU | 610 |
| CA004698 | usGfsuuauUfuuggGfaCfgAfcugsgsu | 371 | UGUUAUUUUGGGACGACUGGU | 611 |
| CA004699 | usGfsuuauUfcuggGfaUfgAfcugsgsu | 372 | UGUUAUUCUGGGAUGACUGGU | 612 |

TABLE 3-continued

INHBE RNAi Agent Antisense Strand Sequences

| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA004700 | usGfsuuauUfcuggGfaCfgAfuugsgsu | 373 | UGUUAUUCUGGGACGAUUGGU | 613 |
| CA004701 | usGfsuuauUfcuggGfaUfgAfuugsgsu | 374 | UGUUAUUCUGGGAUGAUUGGU | 614 |
| CA004703 | usGfsuuauUfuuggGfaCfgAfuugsgsu | 375 | UGUUAUUUUGGGACGAUUGGU | 615 |
| CA004704 | usGfsuuaudTcuggdGaCfgdAuugsgsu | 376 | UGUUAUTCUGGGACGAUUGGU | 742 |
| CA004705 | usGfsuuaudTcuggdGaCfgdAdTugsgsu | 377 | UGUUAUTCUGGGACGATUGGU | 743 |
| CA004911 | usUfscggaAfgaucCfuCfaAfgcaassa | 378 | UUCGGAAGAUCCUCAAGCAAA | 616 |
| CA004912 | usUfscggaAfgaucCfuCfaAfgcaassu | 379 | UUCGGAAGAUCCUCAAGCAAU | 617 |
| CA004914 | usUfscggaA$_{UNA}$gaucCfuCfaAfgcaassu | 380 | UUCGGAAGAUCCUCAAGCAAU | 617 |
| CA004915 | cPrpusUfscggaA$_{UNA}$gaucCfuCfaAfgcaassu | 381 | UUCGGAAGAUCCUCAAGCAAU | 617 |
| CA004973 | usUfsgaccAfcauuGfcCfaUfuaugssu | 382 | UUGACCACAUUGCCAUUAUGU | 618 |
| CA004985 | usUfsgucuAfugauGfgUfaGfcaaasg | 383 | UUGUCUAUGAUGGUAGCAAAG | 619 |
| CA005092 | usUfsaugaUfccagGfuAfgAfggagssu | 384 | UUAUGAUCCAGGUAGAGGAGU | 620 |
| CA005094 | dTssUfsaugaUfccagGfuAfgAfggagssu | 385 | TUAUGAUCCAGGUAGAGGAGU | 744 |
| CA005192 | usGfsuuauUfcuggGfadTgAfcugsgsu | 386 | UGUUAUUCUGGGATGACUGGU | 745 |
| CA005193 | usGfsuuauUfcuggGfadTgAfcuggssu | 387 | UGUUAUUCUGGGATGACUGGU | 745 |
| CA005194 | usGfsuuauUfcuggGfaUfgAfcuggssu | 388 | UGUUAUUCUGGGAUGACUGGU | 612 |
| CA005195 | usGfsuudAuUfcuggGfaUfgAfcuggssu | 389 | UGUUAUUCUGGGAUGACUGGU | 612 |
| CA005196 | usGfsuudAuUfcuggGfadTgAfcuggssu | 390 | UGUUAUUCUGGGATGACUGGU | 745 |
| CA005322 | usAfsuuAfagaaagUfaUfaAfgccassg | 391 | UAUUAAGAAAGUAUAAGCCAG | 621 |
| CA005324 | dTssAfsuuAfagaaagUfaUfaAfgccassg | 392 | TAUUAAGAAAGUAUAAGCCAG | 746 |
| CA005367 | isGfsuuauUfcuggGfaUfgAfcugsgsu | 393 | IGUUAUUCUGGGAUGACUGGU | 622 |
| CA005370 | usGfsuuauUfcuggGfaUfgAfcugsgsc | 394 | UGUUAUUCUGGGAUGACUGGC | 623 |
| CA006198 | usUfsgaccAfcauuGfcCfaUfuaugsi | 395 | UUGACCACAUUGCCAUUAUGI | 624 |
| CA006199 | usUfsaugaUfccagGfuAfgAfggagsi | 396 | UUAUGAUCCAGGUAGAGGAGI | 625 |
| CA006200 | isGfsuuauUfcuggGfaCfgAfcugsgsu | 397 | IGUUAUUCUGGGACGACUGGU | 626 |
| CA006201 | isUfscggaAfgaucCfuCfaAfgcaasa | 398 | IUCGGAAGAUCCUCAAGCAAA | 627 |
| CA006202 | asUfscggaAfgaucCfuCfaAfgcaasi | 399 | AUCGGAAGAUCCUCAAGCAAI | 628 |
| CA006203 | isUfscggaAfgaucCfuCfaAfgcaasi | 400 | IUCGGAAGAUCCUCAAGCAAI | 629 |
| CA007066 | isUfscggaAfgaucCfuCfaAfgcaassu | 401 | IUCGGAAGAUCCUCAAGCAAU | 630 |
| CA007067 | usUfsuggaAfgaucCfuCfaAfgcaassu | 402 | UUUGGAAGAUCCUCAAGCAAU | 631 |
| CA007069 | cPrpusUfscggaAfgaucCfuCfaAfgcaassu | 403 | UUCGGAAGAUCCUCAAGCAAU | 617 |
| CA007070 | dTssUfscggaAfgaucCfuCfaAfgcaassu | 404 | TUCGGAAGAUCCUCAAGCAAU | 747 |
| CA007071 | usUfscggaAfgaucCfuUfaAfgcaassu | 405 | UUCGGAAGAUCCUUAAGCAAU | 632 |
| CA007075 | usAfsuuAfaGfaaagUfaUfaAfgccassg | 406 | UAUUAAGAAAGUAUAAGCCAG | 621 |
| CA007078 | cPrpusAfsuuAfagaaagUfaUfaAfgccassg | 407 | UAUUAAGAAAGUAUAAGCCAG | 621 |
| CA007441 | usAfsgcugUfaggcUfgAfaGfuggassg | 408 | UAGCUGUAGGCUGAAGUGGAG | 633 |

TABLE 3-continued

| INHBE RNAi Agent Antisense Strand Sequences | | | | |
|---|---|---|---|---|
| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
| CA007443 | usGfsauccUfcaagCfaAfaGfagugssc | 409 | UGAUCCUCAAGCAAAGAGUGC | 634 |
| CA007445 | usCfsagguUfggugAfuGfuGfgugcssu | 410 | UCAGGUUGGUGAUGUGGUGCU | 635 |
| CA007447 | usUfscggaUfcuuaAfgCfuCfuaggssu | 411 | UUCGGAUCUUAAGCUCUAGGU | 636 |
| CA007449 | usCfsagaaUfggaaAfgAfgGfcagcssu | 412 | UCAGAAUGGAAAGAGGCAGCU | 637 |
| CA007451 | usCfsaucuUfggucUfcUfuCfacucssc | 413 | UCAUCUUGGUCUCUUCACUCC | 638 |
| CA007453 | usAfsagugAfgucaUfaUfuGfccagssg | 414 | UAAGUGAGUCAUAUUGCCAGG | 639 |
| CA007455 | usGfsaaagUfgcccAfuUfuGfggucssc | 415 | UGAAAGUGCCCAUUUGGGUCC | 640 |
| CA007457 | usGfsacaaGfaaagUfgCfcCfauuussg | 416 | UGACAAGAAAGUGCCCAUUUG | 641 |
| CA007459 | usCfsaucuAfucugCfuUfcCfuccussc | 417 | UCAUCUAUCUGCUUCCUCCUC | 642 |
| CA007461 | usUfsaaauGfcuugUfcUfcCfcagussg | 418 | UUAAAUGCUUGUCUCCCAGUG | 643 |
| CA007463 | usAfsguauAfaaugCfuUfgUfcuccssc | 419 | UAGUAUAAAUGCUUGUCUCCC | 644 |
| CA007465 | usAfsaguaUfaaauGfcUfuGfucucssc | 420 | UAAGUAUAAAUGCUUGUCUCC | 645 |
| CA007467 | usAfsagaaAfguauAfaGfcCfaggcssg | 421 | UAAGAAAGUAUAAGCCAGGCG | 646 |
| CA007469 | usUfsaagaAfaguaUfaAfgCfcaggssc | 422 | UUAAGAAAGUAUAAGCCAGGC | 647 |
| CA007636 | usAfsuuAfagaaagUfaUfaAfgccasg | 423 | UAUUAAGAAAGUAUAAGCCAG | 621 |
| CA008796 | usGfsacAfagaaagUfgCfcCfauuussg | 424 | UGACAAGAAAGUGCCCAUUUG | 641 |
| CA008801 | cPrpusGfsacaaGfaaagUfgCfcCfauuussg | 425 | UGACAAGAAAGUGCCCAUUUG | 641 |
| CA008802 | dTssGfacaaGfaaagUfgCfcCfauuussg | 426 | TGACAAGAAAGUGCCCAUUUG | 748 |
| CA008803 | dTssGfsacaaGfaaagUfgCfcCfauuussg | 427 | TGACAAGAAAGUGCCCAUUUG | 748 |
| CA008808 | usUfsaaAfugcuugUfcUfcCfcagussg | 428 | UUAAAUGCUUGUCUCCCAGUG | 643 |
| CA008809 | dTssUfsaaauGfcuugUfcUfcCfcagussg | 429 | TUAAAUGCUUGUCUCCCAGUG | 749 |
| CA008811 | usUfsaaauGfcuugUfcUfcUfcagussg | 430 | UUAAAUGCUUGUCUCUCAGUG | 648 |
| CA008813 | cPrpusUfsaaauGfcuugUfcUfcCfcagussg | 431 | UUAAAUGCUUGUCUCCCAGUG | 643 |
| CA009835 | dTssGfsacaaGfaaagUfgCfcCfaucussg | 432 | TGACAAGAAAGUGCCCAUCUG | 750 |
| CA009837 | dTssGfsacaaGfaaagUfgCfcCfauucssg | 433 | TGACAAGAAAGUGCCCAUUCG | 751 |
| CA009838 | cPrpusGfsacaaGfaaagUfgCfcCfaucussg | 434 | UGACAAGAAAGUGCCCAUCUG | 649 |
| CA009839 | cPrpusGfsacaaGfaaagUfgCfcCfauucssg | 435 | UGACAAGAAAGUGCCCAUUCG | 650 |
| CA010140 | dTssgsacaagaAfAfGfugcccauuussg | 440 | TGACAAGAAAGUGCCCAUUUG | 748 |
| CA010516 | dTssGfsacaaGfaaagUfgUfcCfauuussg | 441 | TGACAAGAAAGUGUCCAUUUG | 753 |
| CA010518 | dTssGfsacaaGfaaagUfgUfcCfauucssg | 442 | TGACAAGAAAGUGUCCAUUCG | 754 |
| CA010520 | usGfsuuAfagaaagUfaUfaAfgccassg | 443 | UGUUAAGAAAGUAUAAGCCAG | 654 |
| CA010522 | usAfsuuAfaggaagUfaUfaAfgccassg | 444 | UAUUAAGGAAGUAUAAGCCAG | 655 |
| CA011436 | usasuuaagaAfaGfUfauaagccassg | 445 | UAUUAAGAAAGUAUAAGCCAG | 621 |
| CA011474 | dTssGfsacaaGfaaagUfgCfcCfauuusg | 446 | TGACAAGAAAGUGCCCAUUUG | 748 |
| CA011475 | cPrpusAfsuuAfagaaagUfaUfaAfgccasg | 447 | UAUUAAGAAAGUAUAAGCCAG | 621 |
| CA915244 | usCfscsUfcAfagcaaAfgAfgUfgCfcasg | 448 | UCCUCAAGCAAAGAGUGCCAG | 656 |

TABLE 3-continued

INHBE RNAi Agent Antisense Strand Sequences

| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA915246 | asUfscsGfgAfagaucCfuCfaAfgCfaasa | 449 | AUCGGAAGAUCCUCAAGCAAA | 657 |
| CA915248 | usCfsusAfgUfugcagUfuUfcAfgGfacsa | 450 | UCUAGUUGCAGUUUCAGGACA | 658 |
| CA915250 | usUfscsUfaGfuugcaGfuUfuCfaGfgasc | 451 | UUCUAGUUGCAGUUUCAGGAC | 659 |
| CA915252 | usGfsasUfcUfuaagcUfcUfaGfgAfagsg | 452 | UGAUCUUAAGCUCUAGGAAGG | 660 |
| CA915254 | usAfsgsUfaAfuucagCfuGfgUfaCfccsc | 453 | UAGUAAUUCAGCUGGUACCCC | 661 |
| CA915256 | usGfscsAfgUfaauucAfgCfuGfgUfacsc | 454 | UGCAGUAAUUCAGCUGGUACC | 662 |
| CA915258 | usAfsgsAfaUfggaaaGfaGfgCfaGfcasa | 455 | UAGAAUGGAAAGAGGCAGCAA | 663 |
| CA915260 | usUfsasUfgAfuccagGfuAfgAfgGfagsa | 456 | UUAUGAUCCAGGUAGAGGAGA | 664 |
| CA915262 | usUfsgsAfcCfacauuGfcCfaUfuAfugsa | 457 | UUGACCACAUUGCCAUUAUGA | 665 |
| CA915264 | usCfsusUfgAfccacaUfuGfcCfaUfuasu | 458 | UCUUGACCACAUUGCCAUUAU | 666 |
| CA915266 | usGfsasAfuCfugaugCfcUfcCfaGfucsa | 459 | UGAAUCUGAUGCCUCCAGUCA | 667 |
| CA915268 | usAfsgsUfcAfuauugCfcAfgGfuGfgusu | 460 | UAGUCAUAUUGCCAGGUGGUU | 668 |
| CA915270 | usCfsasUfaGfgggucAfaGfuGfaGfucsa | 461 | UCAUAGGGGUCAAGUGAGUCA | 669 |
| CA915272 | asCfsasAfgAfaagugCfcCfaUfuUfggsg | 462 | ACAAGAAAGUGCCCAUUUGGG | 670 |
| CA915274 | usAfsasCfaCfaucagCfcAfaCfcUfggsa | 463 | UAACACAUCAGCCAACCUGGA | 671 |
| CA915276 | usGfscsUfuAfcccugCfuUfcAfaGfccsu | 464 | UGCUUACCCUGCUUCAAGCCU | 672 |
| CA915278 | usUfsgsCfuUfacccuGfcUfuCfaAfgcsc | 465 | UUGCUUACCCUGCUUCAAGCC | 673 |
| CA915280 | usGfsasAfcUfucuuaGfgCfuUfaGfugsc | 466 | UGAACUUCUUAGGCUUAGUGC | 674 |
| CA915282 | usAfsusUfaAfgaaagUfaUfaAfgCfcasg | 467 | UAUUAAGAAAGUAUAAGCCAG | 621 |
| CA915611 | usGfscsaGfuaauucAfgCfuGfguacsc | 468 | UGCAGUAAUUCAGCUGGUACC | 662 |
| CA915612 | usGfscsaguAfauucAfgCfuGfguacsc | 469 | UGCAGUAAUUCAGCUGGUACC | 662 |
| CA915613 | usGfscsaguAfaUfucagCfuGfguacsc | 470 | UGCAGUAAUUCAGCUGGUACC | 662 |
| CA915614 | usGfscsaGfu$A_{UNA}$aUfucagCfuGfguacsc | 471 | UGCAGUAAUUCAGCUGGUACC | 662 |
| CA915615 | usGfscsaGfu$A_{UNA}$auucAfgCfuGfguacsc | 472 | UGCAGUAAUUCAGCUGGUACC | 662 |
| CA915617 | usGfscaguAfauucAfgCfuGfguacsc | 473 | UGCAGUAAUUCAGCUGGUACC | 662 |
| CA915620 | dTssGfscaguAfauucAfgCfuGfguacsc | 474 | TGCAGUAAUUCAGCUGGUACC | 755 |
| CA915621 | cPrpusGfscaguAfauucAfgCfuGfguacsc | 475 | UGCAGUAAUUCAGCUGGUACC | 662 |
| CA915622 | usUfsgsaCfcacauuGfcCfaUfuaugsa | 476 | UUGACCACAUUGCCAUUAUGA | 665 |
| CA915623 | usUfsgsaccAfcauuGfcCfaUfuaugsa | 477 | UUGACCACAUUGCCAUUAUGA | 665 |
| CA915624 | usUfsgsaccAfcAfuugcCfaUfuaugsa | 478 | UUGACCACAUUGCCAUUAUGA | 665 |
| CA915625 | usUfsgsaCfc$A_{UNA}$CAfuugcCfaUfuaugsa | 479 | UUGACCACAUUGCCAUUAUGA | 665 |
| CA915626 | usUfsgsaCfc$A_{UNA}$cauuGfcCfaUfuaugsa | 480 | UUGACCACAUUGCCAUUAUGA | 665 |
| CA915628 | usUfsgaccAfcauuGfcCfaUfuaugsa | 481 | UUGACCACAUUGCCAUUAUGA | 665 |
| CA915631 | dTssUfsgaccAfcauuGfcCfaUfuaugsa | 482 | TUGACCACAUUGCCAUUAUGA | 756 |
| CA915632 | cPrpusUfsgaccAfcauuGfcCfaUfuaugsa | 483 | UUGACCACAUUGCCAUUAUGA | 665 |
| CA916159 | usUfsgaccAfcauuGfcCfaUfuaugssa | 484 | UUGACCACAUUGCCAUUAUGA | 665 |

TABLE 3-continued

INHBE RNAi Agent Antisense Strand Sequences

| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA916160 | usUfsgaccdAcauuGfcCfaUfuaugsa | 485 | UUGACCACAUUGCCAUUAUGA | 665 |
| CA916161 | usUfsgacc$A_{UNA}$cauuGfcCfaUfuaugsa | 486 | UUGACCACAUUGCCAUUAUGA | 665 |
| CA916163 | usUfsgaccAfcauuGfcCfaUfuaugsu | 487 | UUGACCACAUUGCCAUUAUGU | 618 |
| CA916168 | asdGsuudAudTcuggdGaCfgacugguscsu | 488 | AGUUAUTCUGGGACGACUGGUCU | 752 |
| CA916170 | asUfsgadAg$U_{UNA}$ggagucUfgUfgacagsusa | 489 | AUGAAGUGGAGUCUGUGACAGUA | 675 |
| CA916171 | asUfscggaAfgaucCfuCfaAfgcaasa | 490 | AUCGGAAGAUCCUCAAGCAAA | 657 |
| CA916172 | asUfscggaAfgaucCfuCfaAfgcaassa | 491 | AUCGGAAGAUCCUCAAGCAAA | 657 |
| CA916176 | usUfscggaAfgaucCfuCfaAfgcaasa | 492 | UUCGGAAGAUCCUCAAGCAAA | 616 |
| CA916178 | usUfscggaAfgaucCfuCfaAfgcaasu | 493 | UUCGGAAGAUCCUCAAGCAAU | 617 |
| CA916182 | cPrpusUfscggaAfgaucCfuCfaAfgcaasu | 494 | UUCGGAAGAUCCUCAAGCAAU | 617 |
| CA916185 | usUfsaugaUfccagGfuAfgAfggagsa | 495 | UUAUGAUCCAGGUAGAGGAGA | 664 |
| CA916186 | usUfsaugaUfccagGfuAfgAfggagssa | 496 | UUAUGAUCCAGGUAGAGGAGA | 664 |
| CA916187 | usUfsaugadTccagGfuAfgAfggagsa | 497 | UUAUGATCCAGGUAGAGGAGA | 757 |
| CA916188 | usUfsauga$U_{UNA}$ccagGfuAfgAfggagsa | 498 | UUAUGAUCCAGGUAGAGGAGA | 664 |
| CA916192 | usUfsaugaUfccagGfuAfgAfggagsu | 499 | UUAUGAUCCAGGUAGAGGAGU | 620 |
| CA916193 | cPrpusUfsaugaUfccagGfuAfgAfggagsu | 500 | UUAUGAUCCAGGUAGAGGAGU | 620 |
| CA916197 | usAfsuuaaGfaaagUfaUfaAfgccasg | 501 | UAUUAAGAAAGUAUAAGCCAG | 621 |
| CA916198 | usAfsuuaaGfaaagUfaUfaAfgccassg | 502 | UAUUAAGAAAGUAUAAGCCAG | 621 |
| CA916199 | usAfsuuaadGaaagUfaUfaAfgccasg | 503 | UAUUAAGAAAGUAUAAGCCAG | 621 |
| CA916200 | usAfsuuaa$G_{UNA}$aaagUfaUfaAfgccasg | 504 | UAUUAAGAAAGUAUAAGCCAG | 621 |
| CA916203 | usAfsuuaaGfaaagUfaUfaAfgucasg | 505 | UAUUAAGAAAGUAUAAGUCAG | 676 |
| CA916204 | cPrpusAfsuuaaGfaaagUfaUfaAfgccasg | 506 | UAUUAAGAAAGUAUAAGCCAG | 621 |

TABLE 4

INHBE RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004696 | (NAG37)sasccagucgUfCfCfcagaauaacas(invAb) | 507 | ACCAGUCGUCCCAGAAUAACA | 677 |
| CS004702 | (NAG37)sasccagucgUfUfCfcagaauaacas(invAb) | 508 | ACCAGUCGUUCCAGAAUAACA | 678 |
| CS004706 | (NAG37)sasccagucgUfCfCfcagaauaauas(invAb) | 509 | ACCAGUCGUCCCAGAAUAAUA | 679 |
| CS004913 | (NAG37)s(invAb)sauugcuugAfgGfAfucuuccgaas(invAb) | 510 | AUUGCUUGAGGAUCUUCCGAA | 680 |
| CS004974 | (NAG37)s(invAb)sacauaaugGfcAfAfuguggucaas(invAb) | 511 | ACAUAAUGGCAAUGUGGUCAA | 681 |
| CS004975 | (NAG37)s(invAb)sacauaaugGfcAfaUfguggucaas(invAb) | 512 | ACAUAAUGGCAAUGUGGUCAA | 681 |
| CS004984 | (NAG37)s(invAb)scuuugcuaCfCfAfucauagacaas(invAb) | 513 | CUUUGCUACCAUCAUAGACAA | 682 |
| CS005093 | (NAG37)s(invAb)sacuccucuAfcCfuGfgaucauaas(invAb) | 514 | ACUCCUCUACCUGGAUCAUAA | 683 |

TABLE 4-continued

INHBE RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS005323 | (NAG37)s(invAb)scuggcuuaUfaCfUfuucuuaauas(invAb) | 515 | CUGGCUUAUACUUUCUUAAUA | 684 |
| CS005368 | (NAG37)sasccagucgUfCfCfuagaauaacas(invAb) | 516 | ACCAGUCGUCCUAGAAUAACA | 685 |
| CS005369 | (NAG37)sgsccagucgUfCfCfcagaauaacas(invAb) | 517 | GCCAGUCGUCCCAGAAUAACA | 686 |
| CS007065 | (NAG37)s(invAb)sauugcuugAfgGfAfucuuccgaus(invAb) | 518 | AUUGCUUGAGGAUCUUCCGAU | 687 |
| CS007068 | (NAG37)s(invAb)sauugcuugAfgGfAfucuucugaas(invAb) | 519 | AUUGCUUGAGGAUCUUCUGAA | 688 |
| CS007076 | (NAG37)s(invAb)scuggcuuaUfaCfUfuucuuaa_2Nuas(invAb) | 520 | CUGGCUUAUACUUUCUUA($^{A2N}$)UA | 689 |
| CS007077 | (NAG37)s(invAb)scuggcuuaUfaCfUfuucuua_2Nauas(invAb) | 521 | CUGGCUUAUACUUUCUU($^{A2N}$)AUA | 690 |
| CS007440 | (NAG37)s(invAb)scuccacuuCfAfGfccuacaicuas(invAb) | 522 | CUCCACUUCAGCCUACAICUA | 691 |
| CS007442 | (NAG37)s(invAb)sgcacucuuUfGfCfuugagiaucas(invAb) | 523 | GCACUCUUUGCUUGAGIAUCA | 692 |
| CS007444 | (NAG37)s(invAb)sagcaccacAfUfCfaccaaccugas(invAb) | 524 | AGCACCACAUCACCAACCUGA | 693 |
| CS007446 | (NAG37)s(invAb)saccuagagCfUfUfaagaucciaas(invAb) | 525 | ACCUAGAGCUUAAGAUCCIAA | 694 |
| CS007448 | (NAG37)s(invAb)sagcugccuCfUfUfuccauucugas(invAb) | 526 | AGCUGCCUCUUUCCAUUCUGA | 695 |
| CS007450 | (NAG37)s(invAb)sggagugaaGfAfGfaccaagaugas(invAb) | 527 | GGAGUGAAGAGACCAAGAUGA | 696 |
| CS007452 | (NAG37)s(invAb)sccuggcaaUfAfUfgacucacuuas(invAb) | 528 | CCUGGCAAUAUGACUCACUUA | 697 |
| CS007454 | (NAG37)s(invAb)sggacccaaAfUfGfggcacuuucas(invAb) | 529 | GGACCCAAAUGGGCACUUUCA | 698 |
| CS007456 | (NAG37)s(invAb)scaaaugggCfAfCfuuucuugucas(invAb) | 530 | CAAAUGGGCACUUUCUUGUCA | 699 |
| CS007458 | (NAG37)s(invAb)sgaggaggaAfGfCfagauagaugas(invAb) | 531 | GAGGAGGAAGCAGAUAGAUGA | 700 |
| CS007460 | (NAG37)s(invAb)scacugggaGfAfCfaagcauuua_2Nas(invAb) | 532 | CACUGGGAGACAAGCAUUU($^{A2N}$)A | 701 |
| CS007462 | (NAG37)s(invAb)sgggagacaAfGfCfauuuauacuas(invAb) | 533 | GGGAGACAAGCAUUUAUACUA | 702 |
| CS007464 | (NAG37)s(invAb)sggagacaaGfCfAfuuuauacuuas(invAb) | 534 | GGAGACAAGCAUUUAUACUUA | 703 |
| CS007466 | (NAG37)s(invAb)scgccuggcUfUfAfuacuuucuuas(invAb) | 535 | CGCCUGGCUUAUACUUUCUUA | 704 |
| CS007468 | (NAG37)s(invAb)sgccuggcuUfAfUfacuuucuuaas(invAb) | 536 | GCCUGGCUUAUACUUUCUUAA | 705 |
| CS008147 | (NAG37)s(invAb)scuggcuuaUfaCfUfuucuuaauas(invAb) NH-C6 | 537 | CUGGCUUAUACUUUCUUAAUA | 684 |
| CS008797 | (NAG37)s(invAb)scaaaugggCfaCfUfuucuugucas(invAb) | 538 | CAAAUGGGCACUUUCUUGUCA | 699 |
| CS008798 | (NAG37)s(invAb)scaaaugggCfAfCfuuucuuguuas(invAb) | 539 | CAAAUGGGCACUUUCUUGUUA | 706 |
| CS008799 | (NAG37)s(invAb)scaaaugggCfAfCfuuuuuugucas(invAb) | 540 | CAAAUGGGCACUUUUUUGUCA | 707 |
| CS008800 | (NAG37)s(invAb)scaaaugggCfAfCfuuucuuiucas(invAb) | 541 | CAAAUGGGCACUUUCUUIUCA | 708 |
| CS008804 | (NAG37)s(invAb)sca_2NaaugggCfAfCfuuucuugucas(invAb) | 542 | C($^{A2N}$)AAUGGGCACUUUCUUGUCA | 709 |
| CS008805 | (NAG37)s(invAb)scaa_2NaugggCfAfCfuuucuugucas(invAb) | 543 | CA($^{A2N}$)AUGGGCACUUUCUUGUCA | 710 |
| CS008806 | (NAG37)s(invAb)scaaa_2NugggCfAfCfuuucuugucas(invAb) | 544 | CAA($^{A2N}$)UGGGCACUUUCUUGUCA | 711 |
| CS008807 | (NAG37)s(invAb)scacugggaGfaCfAfagcauuua_2Nas(invAb) | 545 | CACUGGGAGACAAGCAUUU($^{A2N}$)A | 701 |
| CS008810 | (NAG37)s(invAb)sca_2NcugggaGfAfCfaagcauuua_ 2Nas(invAb) | 546 | C($^{A2N}$)CUGGGAGACAAGCAUUU ($^{A2N}$)A | 712 |
| CS008812 | (NAG37)s(invAb)scacugigaGfAfCfaagcauuua_2Nas(invAb) | 547 | CACUGIGAGACAAGCAUUU($^{A2N}$)A | 713 |
| CS008814 | (NAG37)s(invAb)scacugggaGfAfCfaagcauuuaas(invAb) | 548 | CACUGGGAGACAAGCAUUUAA | 714 |
| CS008815 | (NAG37)s(invAb)scacugggaGfAfCfaagca_2Nuuuaas(invAb) | 549 | CACUGGGAGACAAGC($^{A2N}$)UUUAA | 715 |

TABLE 4-continued

| INHBE RNAi Agent Sense Strand Sequences | | | | |
|---|---|---|---|---|
| Sense Strand ID: | Modified Sense Strand (5' → 3') | SEQ ID NO. | Underlying Base Sequence (5' → 3') (Shown as an Unmodified Nucleotide Sequence) | SEQ ID NO. |
| CS009834 | (NAG37)s(invAb)scagaugggCfaCfUfuucuugucas(invAb) | 550 | CAGAUGGGCACUUUCUUGUCA | 716 |
| CS009836 | (NAG37)s(invAb)scgaaugggCfaCfUfuucuugucas(invAb) | 551 | CGAAUGGGCACUUUCUUGUCA | 717 |
| CS010055 | (NAG37)s(invAb)scuggcuuaUfaCfUfuucuuaauas(invAb)sC6-NH2 | 552 | CUGGCUUAUACUUUCUUAAUA | 684 |
| CS010057 | (NAG37)s(invAb)sauugcuugAfgGfAfucuuccgaas(invAb)sC6-NH2 | 553 | AUUGCUUGAGGAUCUUCCGAA | 680 |
| CS010059 | (NAG37)s(invAb)scaaaugggCfAfCfuuucuugucas(invAb)sC6-NH2 | 554 | CAAAUGGGCACUUUCUUGUCA | 699 |
| CS010061 | (NAG37)sasccagucgUfCfCfcagaauaacus(invAb)sC6-NH2 | 555 | ACCAGUCGUCCCAGAAUAACU | 718 |
| CS010517 | (NAG37)s(invAb)scgaaugggCfAfCfuuucuugucas(invAb) | 556 | CGAAUGGGCACUUUCUUGUCA | 717 |
| CS010519 | (NAG37)s(invAb)scuggcuuaUfaCfUfuucuuaacas(invAb) | 557 | CUGGCUUAUACUUUCUUAACA | 719 |
| CS010521 | (NAG37)s(invAb)scuggcuuaUfaCfUfuccuuaauas(invAb) | 558 | CUGGCUUAUACUUCCUUAAUA | 720 |
| CS915243 | (NAG37)s(invAb)scuggcacuCfUfUfugcuugaggas(invAb) | 559 | CUGGCACUCUUUGCUUGAGGA | 721 |
| CS915245 | (NAG37)s(invAb)suuugcuugAfGfGfaucuuccgaus(invAb) | 560 | UUUGCUUGAGGAUCUUCCGAU | 722 |
| CS915247 | (NAG37)s(invAb)suguccugaAfAfCfugcaacuagas(invAb) | 561 | UGUCCUGAAACUGCAACUAGA | 723 |
| CS915249 | (NAG37)s(invAb)sguccugaaAfCfUfgcaacuagaas(invAb) | 562 | GUCCUGAAACUGCAACUAGAA | 724 |
| CS915251 | (NAG37)s(invAb)sccuuccuaGfAfGfcuuaagaucas(invAb) | 563 | CCUUCCUAGAGCUUAAGAUCA | 725 |
| CS915253 | (NAG37)s(invAb)sgggguaccAfGfCfugaauuacuas(invAb) | 564 | GGGGUACCAGCUGAAUUACUA | 726 |
| CS915255 | (NAG37)s(invAb)sgguaccagCfUfGfaauuacugcas(invAb) | 565 | GGUACCAGCUGAAUUACUGCA | 727 |
| CS915257 | (NAG37)s(invAb)suugcugccUfCfUfuuccauucuas(invAb) | 566 | UUGCUGCCUCUUUCCAUUCUA | 728 |
| CS915259 | (NAG37)s(invAb)sucuccucuAfCfCfuggaucauaas(invAb) | 567 | UCUCCUCUACCUGGAUCAUAA | 729 |
| CS915261 | (NAG37)s(invAb)sucauaaugGfCfAfauguggucaas(invAb) | 568 | UCAUAAUGGCAAUGUGGUCAA | 730 |
| CS915263 | (NAG37)s(invAb)sauaauggcAfAfUfguggucaagas(invAb) | 569 | AUAAUGGCAAUGUGGUCAAGA | 731 |
| CS915265 | (NAG37)s(invAb)sugacuggaGfGfCfaucagauucas(invAb) | 570 | UGACUGGAGGCAUCAGAUUCA | 732 |
| CS915267 | (NAG37)s(invAb)saaccaccuGfGfCfaauaugacuas(invAb) | 571 | AACCACCUGGCAAUAUGACUA | 733 |
| CS915269 | (NAG37)s(invAb)sugacucacUfUfGfaccccuaugas(invAb) | 572 | UGACUCACUUGACCCCUAUGA | 734 |
| CS915271 | (NAG37)s(invAb)scccaaaugGfGfCfacuuucuugus(invAb) | 573 | CCCAAAUGGGCACUUUCUUGU | 735 |
| CS915273 | (NAG37)s(invAb)succagguuGfGfCfugauguguuas(invAb) | 574 | UCCAGGUUGGCUGAUGUGUUA | 736 |
| CS915275 | (NAG37)s(invAb)saggcuugaAfGfCfaggguaagcas(invAb) | 575 | AGGCUUGAAGCAGGGUAAGCA | 737 |
| CS915277 | (NAG37)s(invAb)sggcuugaaGfCfAfggguaagcaas(invAb) | 576 | GGCUUGAAGCAGGGUAAGCAA | 738 |
| CS915279 | (NAG37)s(invAb)sgcacuaagCfCfUfaagaaguucas(invAb) | 577 | GCACUAAGCCUAAGAAGUUCA | 739 |
| CS915281 | (NAG37)s(invAb)scuggcuuaUfAfCfuuucuuaauas(invAb) | 578 | CUGGCUUAUACUUUCUUAAUA | 684 |
| CS915616 | (NAG37)s(invAb)sgguaccagCfuGfaauuacugcas(invAb) | 579 | GGUACCAGCUGAAUUACUGCA | 727 |
| CS915618 | (NAG37)s(invAb)sgguaccagCfuGfAfauuacugcas(invAb) | 580 | GGUACCAGCUGAAUUACUGCA | 727 |
| CS915619 | (NAG37)s(invAb)sgguaccAfgCfuGfaauuacugcas(invAb) | 581 | GGUACCAGCUGAAUUACUGCA | 727 |
| CS915627 | (NAG37)s(invAb)sucauaaugGfcAfauguggucaas(invAb) | 582 | UCAUAAUGGCAAUGUGGUCAA | 730 |
| CS915629 | (NAG37)s(invAb)sucauaaugGfcAfAfuguggucaas(invAb) | 583 | UCAUAAUGGCAAUGUGGUCAA | 730 |

TABLE 4-continued

INHBE RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS915630 | (NAG37)s(invAb)sucauaaUfgGfcAfauguggucaas(invAb) | 584 | UCAUAAUGGCAAUGUGGUCAA | 730 |
| CS916162 | (NAG37)s(invAb)sacauaaugGfCfAfauguggucaas(invAb) | 585 | ACAUAAUGGCAAUGUGGUCAA | 681 |
| CS916164 | (NAG37)s(invAb)sacauaaugGfcAfauguggucaas(invAb) | 586 | ACAUAAUGGCAAUGUGGUCAA | 681 |
| CS916165 | (NAG37)s(invAb)sacauaaUfgGfcAfauguggucaas(invAb) | 587 | ACAUAAUGGCAAUGUGGUCAA | 681 |
| CS916166 | (NAG37)suscauaaugGfCfAfauguggucaas(invAb) | 588 | UCAUAAUGGCAAUGUGGUCAA | 730 |
| CS916167 | (NAG37)sasccagucgUfCfCfcagaauaacus(invAb) | 589 | ACCAGUCGUCCCAGAAUAACU | 718 |
| CS916169 | (NAG37)scsugucaCfaGfAfCfuccacuucaus(invAb) | 590 | CUGUCACAGACUCCACUUCAU | 740 |
| CS916173 | (NAG37)s(invAb)suuugcuugAfgGfaucuuccgaus(invAb) | 591 | UUUGCUUGAGGAUCUUCCGAU | 722 |
| CS916174 | (NAG37)s(invAb)suuugcuUfgAfgGfaucuuccgaus(invAb) | 592 | UUUGCUUGAGGAUCUUCCGAU | 722 |
| CS916175 | (NAG37)s(invAb)suuugcuugAfGfGfaucuuccgaas(invAb) | 593 | UUUGCUUGAGGAUCUUCCGAA | 741 |
| CS916177 | (NAG37)s(invAb)sauugcuugAfGfGfaucuuccgaas(invAb) | 594 | AUUGCUUGAGGAUCUUCCGAA | 680 |
| CS916179 | (NAG37)s(invAb)suuugcuUfgAfgGfaucuuccgaas(invAb) | 595 | UUUGCUUGAGGAUCUUCCGAA | 741 |
| CS916180 | (NAG37)s(invAb)sauugcuUfgAfgGfaucuuccgaas(invAb) | 596 | AUUGCUUGAGGAUCUUCCGAA | 680 |
| CS916181 | (NAG37)s(invAb)sauugcuugAfgGfaucuuccgaas(invAb) | 597 | AUUGCUUGAGGAUCUUCCGAA | 680 |
| CS916183 | (NAG37)sasuugcuugAfGfGfaucuuccgaas(invAb) | 598 | AUUGCUUGAGGAUCUUCCGAA | 680 |
| CS916184 | (NAG37)sasuugcuugAfgGfaucuuccgaas(invAb) | 599 | AUUGCUUGAGGAUCUUCCGAA | 680 |
| CS916189 | (NAG37)s(invAb)sucuccucuAfcCfuggaucauaas(invAb) | 600 | UCUCCUCUACCUGGAUCAUAA | 729 |
| CS916190 | (NAG37)s(invAb)sucuccuCfuAfcCfuggaucauaas(invAb) | 601 | UCUCCUCUACCUGGAUCAUAA | 729 |
| CS916191 | (NAG37)s(invAb)sacuccucuAfCfCfuggaucauaas(invAb) | 602 | ACUCCUCUACCUGGAUCAUAA | 683 |
| CS916194 | (NAG37)sascuccucuAfCfCfuggaucauaas(invAb) | 603 | ACUCCUCUACCUGGAUCAUAA | 683 |
| CS916195 | (NAG37)sascuccucuAfcCfuggaucauaas(invAb) | 604 | ACUCCUCUACCUGGAUCAUAA | 683 |
| CS916196 | (NAG37)sascuccuCfuAfcCfuggaucauaas(invAb) | 605 | ACUCCUCUACCUGGAUCAUAA | 683 |
| CS916201 | (NAG37)s(invAb)scuggcuuaUfaCfuuucuuaauas(invAb) | 606 | CUGGCUUAUACUUUCUUAAUA | 684 |
| CS916202 | (NAG37)s(invAb)scuggcuUfaUfaCfuuucuuaauas(invAb) | 607 | CUGGCUUAUACUUUCUUAAUA | 684 |
| CS916205 | (NAG37)scsuggcuuaUfaCfuuucuuaauas(invAb) | 608 | CUGGCUUAUACUUUCUUAAUA | 684 |

($A^{2N}$) = 2-aminoadenine nucleotide; I = hypoxanthine (inosine) nucleotide

The INHBE RNAi agents described herein are formed by annealing an antisense strand with a sense strand. A sense strand containing a sequence listed in Table 2, Table 4, or Table 5C can be hybridized to any antisense strand containing a sequence listed in Table 2, Table 3, or Table 5C provided the two sequences have a region of at least 85% complementarity over a contiguous 15, 16, 17, 18, 19, 20, or 21 nucleotide sequence.

In some embodiments, the antisense strand of an INHBE RNAi agent disclosed herein differs by 0, 1, 2, or 3 nucleotides from any of the antisense strand sequences in Table 3 or Table 5C. In some embodiments, the sense strand of an INHBE RNAi agent disclosed herein differs by 0, 1, 2, or 3 nucleotides from any of the sense strand sequences in Table 4 or Table 5C.

In some embodiments, an INHBE RNAi agent antisense strand comprises a nucleotide sequence of any of the sequences in Table 2, Table 3, or Table 5C. In some embodiments, an INHBE RNAi agent antisense strand comprises the sequence of nucleotides (from 5' end→3' end) at positions 1-17, 2-17, 1-18, 2-18, 1-19, 2-19, 1-20, 2-20, 1-21, or 2-21, of any of the sequences in Table 2, Table 3, or Table 5C. In certain embodiments, an INHBE RNAi agent antisense strand comprises or consists of a modified sequence of any one of the modified sequences in Table 3 or Table 5C.

In some embodiments, an INHBE RNAi agent sense strand comprises the nucleotide sequence of any of the sequences in Table 2, Table 4, or Table 5C. In some embodiments, an INHBE RNAi agent sense strand comprises the sequence of nucleotides (from 5' end→3' end) at positions 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, or 4-21, of any of the sequences in Table 2, Table 4, or Table 5C. In certain embodiments, an INHBE RNAi agent sense strand comprises or consists of a modified sequence of any one of the modified sequences in Table 4 or Table 5C.

For the INHBE RNAi agents disclosed herein, the nucleotide at position 1 of the antisense strand (from 5' end→3' end) can be perfectly complementary to an INHBE gene, or can be non-complementary to an INHBE gene. In some embodiments, the nucleotide at position 1 of the antisense strand (from 5' end→3' end) is a U, A, or dT (or a modified version thereof). In some embodiments, the nucleotide at position 1 of the antisense strand (from 5' end→3' end) forms an A:U or U:A base pair with the sense strand.

A sense strand containing a sequence listed in Table 2, Table 4, or Table 5C can be hybridized to any antisense strand containing a sequence listed in Table 2, Table 3, or Table 5C, provided the two sequences have a region of at least 85% complementarity over a contiguous 16, 17, 18, 19, 20, or 21 nucleotide sequence. In some embodiments, the INHBE RNAi agent has a sense strand consisting of the modified sequence of any of the modified sequences in Table 4 or Table 5C, and an antisense strand consisting of the modified sequence of any of the modified sequences in Table 3 or Table 5C. Certain representative sequence pairings are exemplified by the Duplex ID Nos. shown in Tables 5A, 5B, and 5C.

In some embodiments, an INHBE RNAi agent comprises, consists of, or consists essentially of a duplex represented by any one of the Duplex ID Nos. presented herein. In some embodiments, an INHBE RNAi agent comprises the sense strand and antisense strand nucleotide sequences of any of the duplexes represented by any of the Duplex ID NOs. presented herein. In some embodiments, an INHBE RNAi agent comprises the sense strand and antisense strand nucleotide sequences of any of the duplexes represented by any of the Duplex ID NOs. presented herein and a targeting group and/or linking group wherein the targeting group and/or linking group is covalently linked (i.e., conjugated) to the sense strand or the antisense strand. In some embodiments, an INHBE RNAi agent includes the sense strand and antisense strand modified nucleotide sequences of any of the Duplex ID NOs. presented herein. In some embodiments, an INHBE RNAi agent comprises the sense strand and antisense strand modified nucleotide sequences of any of the Duplex ID NOs. presented herein and a targeting group and/or linking group, wherein the targeting group and/or linking group is covalently linked to the sense strand or the antisense strand.

In some embodiments, an INHBE RNAi agent comprises an antisense strand and a sense strand having the nucleotide sequences of any of the antisense strand/sense strand duplexes of Table 2 or Tables 5A, 5B, and 5C, and further comprises a targeting group or targeting ligand. In some embodiments, an INHBE RNAi agent comprises an antisense strand and a sense strand having the nucleotide sequences of any of the antisense strand/sense strand duplexes of Table 2 or Tables 5A, 5B, and 5C, and further comprises an asialoglycoprotein receptor ligand targeting group.

A targeting group, with or without a linker, can be linked to the 5' or 3' end of any of the sense and/or antisense strands disclosed in Tables 2, 3, 4, or 5C. A linker, with or without a targeting group, can be attached to the 5' or 3' end of any of the sense and/or antisense strands disclosed in Tables 2, 3, 4, and 5C.

In some embodiments, an INHBE RNAi agent comprises an antisense strand and a sense strand having the nucleotide sequences of any of the antisense strand/sense strand duplexes of Table 2 or Tables 5A, 5B and 5C, and further comprises a targeting ligand selected from the group consisting of: (NAG37) and (NAG37)s, each as defined in Table 6.

In some embodiments, an INHBE RNAi agent comprises an antisense strand and a sense strand having the modified nucleotide sequence of any of the antisense strand and/or sense strand nucleotide sequences in Table 3 or Table 4.

In some embodiments, an INHBE RNAi agent comprises an antisense strand and a sense strand having a modified nucleotide sequence of any of the antisense strand and/or sense strand nucleotide sequences of any of the duplexes Tables 5A, 5B3, and 5C, and further comprises an asialoglycoprotein receptor ligand targeting group.

In some embodiments, an INHBE RNAi agent comprises, consists of, or consists essentially of any of the duplexes of Tables 5A, 5B3, and 5C.

TABLE 5A

INHBE RNAi Agents Duplexes with Corresponding Sense and Antisense Strand ID Numbers and Sequence ID numbers for the modified and unmodified nucleotide sequences.

| Duplex ID | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC003824 | CA004695 | 369 | 609 | CS916167 | 589 | 718 |
| AC003825 | CA004697 | 370 | 610 | CS004696 | 507 | 677 |
| AC003826 | CA004698 | 371 | 611 | CS004696 | 507 | 677 |
| AC003827 | CA004699 | 372 | 612 | CS004696 | 507 | 677 |
| AC003828 | CA004700 | 373 | 613 | CS004696 | 507 | 677 |
| AC003829 | CA004701 | 374 | 614 | CS004696 | 507 | 677 |
| AC003830 | CA004700 | 373 | 613 | CS004702 | 508 | 678 |
| AC003831 | CA004703 | 375 | 615 | CS004696 | 507 | 677 |
| AC003832 | CA004704 | 376 | 742 | CS004696 | 507 | 677 |
| AC003833 | CA004705 | 377 | 743 | CS004696 | 507 | 677 |
| AC003834 | CA004700 | 373 | 613 | CS004706 | 509 | 679 |
| AC004005 | CA004911 | 378 | 616 | CS916175 | 593 | 741 |
| AC004006 | CA004912 | 379 | 617 | CS916177 | 594 | 680 |
| AC004007 | CA004912 | 379 | 617 | CS004913 | 510 | 680 |
| AC004008 | CA004914 | 380 | 617 | CS004913 | 510 | 680 |
| AC004009 | CA004915 | 381 | 617 | CS004913 | 510 | 680 |
| AC004045 | CA004973 | 382 | 618 | CS916162 | 585 | 681 |

TABLE 5A-continued

INHBE RNAi Agents Duplexes with Corresponding Sense and Antisense Strand ID Numbers and Sequence ID numbers for the modified and unmodified nucleotide sequences.

| Duplex ID | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC004046 | CA004973 | 382 | 618 | CS004974 | 511 | 681 |
| AC004047 | CA004973 | 382 | 618 | CS004975 | 512 | 681 |
| AC004053 | CA004985 | 383 | 619 | CS004984 | 513 | 682 |
| AC004117 | CA005092 | 384 | 620 | CS916191 | 602 | 683 |
| AC004118 | CA005092 | 384 | 620 | CS005093 | 514 | 683 |
| AC004119 | CA005094 | 385 | 744 | CS916191 | 602 | 683 |
| AC004179 | CA005192 | 386 | 745 | CS004696 | 507 | 677 |
| AC004180 | CA004699 | 372 | 612 | CS004706 | 509 | 679 |
| AC004181 | CA005193 | 387 | 745 | CS004696 | 507 | 677 |
| AC004182 | CA005194 | 388 | 612 | CS004706 | 509 | 679 |
| AC004183 | CA005194 | 388 | 612 | CS004696 | 507 | 677 |
| AC004184 | CA005195 | 389 | 612 | CS004696 | 507 | 677 |
| AC004185 | CA005196 | 390 | 745 | CS004696 | 507 | 677 |
| AC004284 | CA005322 | 391 | 621 | CS915281 | 578 | 684 |
| AC004285 | CA005322 | 391 | 621 | CS005323 | 515 | 684 |
| AC004286 | CA005324 | 392 | 746 | CS915281 | 578 | 684 |
| AC004324 | CA005367 | 393 | 622 | CS916167 | 589 | 718 |
| AC004325 | CA004699 | 372 | 612 | CS005368 | 516 | 685 |
| AC004326 | CA005370 | 394 | 623 | CS005369 | 517 | 686 |
| AC005048 | CA006198 | 395 | 624 | CS915261 | 568 | 730 |
| AC005049 | CA006199 | 396 | 625 | CS915259 | 567 | 729 |
| AC005050 | CA006200 | 397 | 626 | CS916167 | 589 | 718 |
| AC005051 | CA006201 | 398 | 627 | CS915245 | 560 | 722 |
| AC005052 | CA006202 | 399 | 628 | CS915245 | 560 | 722 |
| AC005053 | CA006203 | 400 | 629 | CS915245 | 560 | 722 |
| AC005809 | CA007066 | 401 | 630 | CS007065 | 518 | 687 |
| AC005810 | CA007067 | 402 | 631 | CS004913 | 510 | 680 |
| AC005811 | CA004912 | 379 | 617 | CS007068 | 519 | 688 |
| AC005812 | CA007069 | 403 | 617 | CS004913 | 510 | 680 |
| AC005813 | CA007070 | 404 | 747 | CS004913 | 510 | 680 |
| AC005814 | CA007071 | 405 | 632 | CS004913 | 510 | 680 |
| AC005817 | CA007075 | 406 | 621 | CS005323 | 515 | 684 |
| AC005818 | CA005322 | 391 | 621 | CS007076 | 520 | 689 |
| AC005819 | CA005322 | 391 | 621 | CS007077 | 521 | 690 |
| AC005820 | CA007078 | 407 | 621 | CS005323 | 515 | 684 |
| AC005821 | CA005324 | 392 | 746 | CS005323 | 515 | 684 |
| AC006192 | CA007441 | 408 | 633 | CS007440 | 522 | 691 |
| AC006193 | CA007443 | 409 | 634 | CS007442 | 523 | 692 |
| AC006194 | CA007447 | 411 | 636 | CS007446 | 525 | 694 |
| AC006195 | CA007449 | 412 | 637 | CS007448 | 526 | 696 |
| AC006196 | CA007455 | 415 | 640 | CS007454 | 529 | 698 |
| AC006197 | CA007457 | 416 | 641 | CS007456 | 530 | 699 |
| AC006198 | CA007459 | 417 | 642 | CS007458 | 531 | 700 |
| AC006199 | CA007461 | 418 | 643 | CS007460 | 532 | 701 |
| AC006200 | CA007463 | 419 | 644 | CS007462 | 533 | 702 |
| AC006201 | CA007465 | 420 | 645 | CS007464 | 534 | 703 |
| AC006202 | CA007467 | 421 | 646 | CS007466 | 535 | 704 |
| AC006203 | CA007469 | 422 | 647 | CS007468 | 536 | 705 |
| AC006210 | CA007445 | 410 | 635 | CS007444 | 524 | 693 |
| AC006211 | CA007451 | 413 | 638 | CS007450 | 527 | 696 |
| AC006212 | CA007453 | 414 | 639 | CS007452 | 528 | 697 |
| AC006559 | CA007078 | 407 | 621 | CS007076 | 520 | 689 |
| AC006560 | CA005324 | 392 | 746 | CS007076 | 520 | 689 |
| AC006561 | CA007078 | 407 | 621 | CS007077 | 521 | 690 |
| AC006562 | CA005324 | 392 | 746 | CS007077 | 521 | 690 |
| AC006816 | CA005322 | 391 | 621 | CS008147 | 537 | 684 |
| AC007393 | CA008796 | 424 | 641 | CS007456 | 530 | 699 |
| AC007394 | CA007457 | 416 | 641 | CS008797 | 538 | 699 |
| AC007395 | CA007457 | 416 | 641 | CS008798 | 539 | 706 |
| AC007396 | CA007457 | 416 | 641 | CS008799 | 540 | 707 |
| AC007397 | CA007457 | 416 | 641 | CS008800 | 541 | 708 |
| AC007398 | CA008801 | 425 | 641 | CS007456 | 530 | 699 |
| AC007399 | CA008802 | 426 | 748 | CS007456 | 530 | 699 |
| AC007400 | CA008803 | 427 | 748 | CS007456 | 530 | 699 |
| AC007401 | CA007457 | 416 | 641 | CS008804 | 542 | 709 |
| AC007402 | CA007457 | 416 | 641 | CS008805 | 543 | 710 |
| AC007403 | CA007457 | 416 | 641 | CS008806 | 544 | 711 |
| AC007404 | CA007461 | 418 | 643 | CS008807 | 545 | 701 |
| AC007405 | CA008808 | 428 | 643 | CS007460 | 532 | 701 |
| AC007406 | CA008809 | 429 | 749 | CS007460 | 532 | 701 |
| AC007407 | CA007461 | 418 | 643 | CS008810 | 546 | 712 |

TABLE 5A-continued

INHBE RNAi Agents Duplexes with Corresponding Sense and Antisense Strand ID Numbers and Sequence ID numbers for the modified and unmodified nucleotide sequences.

| Duplex ID | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC007408 | CA008811 | 430 | 648 | CS007460 | 532 | 701 |
| AC007409 | CA007461 | 418 | 643 | CS008812 | 547 | 713 |
| AC007410 | CA008813 | 431 | 643 | CS007460 | 532 | 701 |
| AC007411 | CA007461 | 418 | 643 | CS008814 | 548 | 714 |
| AC007412 | CA007461 | 418 | 643 | CS008815 | 549 | 715 |
| AC008274 | CA009835 | 432 | 750 | CS009834 | 550 | 716 |
| AC008275 | CA009837 | 433 | 751 | CS009836 | 551 | 717 |
| AC008276 | CA009838 | 434 | 649 | CS009834 | 550 | 716 |
| AC008277 | CA009839 | 435 | 650 | CS009836 | 551 | 717 |
| AC008278 | CA008803 | 427 | 748 | CS008797 | 538 | 699 |
| AC008279 | CA008801 | 425 | 641 | CS008797 | 538 | 699 |
| AC008547 | CA010140 | 440 | 748 | CS007456 | 530 | 699 |
| AC008888 | CA010516 | 441 | 753 | CS007456 | 530 | 699 |
| AC008889 | CA009837 | 433 | 751 | CS010517 | 556 | 717 |
| AC008890 | CA010518 | 442 | 754 | CS010517 | 556 | 717 |
| AC008891 | CA010520 | 443 | 654 | CS010519 | 557 | 719 |
| AC008892 | CA010522 | 444 | 655 | CS010521 | 558 | 720 |
| AC009715 | CA011436 | 445 | 621 | CS005323 | 515 | 684 |
| AC009757 | CA007636 | 423 | 621 | CS005323 | 515 | 684 |
| AC009758 | CA007636 | 423 | 621 | CS007076 | 520 | 689 |
| AC009759 | CA007636 | 423 | 621 | CS007077 | 521 | 690 |
| AC009760 | CA011474 | 446 | 748 | CS007456 | 530 | 699 |
| AC009761 | CA011475 | 447 | 621 | CS005323 | 515 | 684 |
| AC009762 | CA011475 | 447 | 621 | CS007076 | 520 | 689 |
| AC009763 | CA011475 | 447 | 621 | CS007077 | 521 | 690 |
| AC911855 | CA915244 | 448 | 656 | CS915243 | 559 | 721 |
| AC911856 | CA915246 | 449 | 657 | CS915245 | 560 | 722 |
| AC911857 | CA915248 | 450 | 658 | CS915247 | 561 | 723 |
| AC911858 | CA915250 | 451 | 659 | CS915249 | 562 | 724 |
| AC911859 | CA915252 | 452 | 660 | CS915251 | 563 | 725 |
| AC911860 | CA915254 | 453 | 661 | CS915253 | 564 | 726 |
| AC911861 | CA915256 | 454 | 662 | CS915255 | 565 | 727 |
| AC911862 | CA915258 | 455 | 663 | CS915257 | 566 | 728 |
| AC911863 | CA915260 | 456 | 664 | CS915259 | 567 | 729 |
| AC911864 | CA915262 | 457 | 665 | CS915261 | 568 | 730 |
| AC911865 | CA915264 | 458 | 666 | CS915263 | 569 | 731 |
| AC911866 | CA915266 | 459 | 667 | CS915265 | 570 | 732 |
| AC911867 | CA915268 | 460 | 668 | CS915267 | 571 | 733 |
| AC911868 | CA915270 | 461 | 669 | CS915269 | 572 | 734 |
| AC911869 | CA915272 | 462 | 670 | CS915271 | 573 | 735 |
| AC911870 | CA915274 | 463 | 671 | CS915273 | 574 | 736 |
| AC911871 | CA915276 | 464 | 672 | CS915275 | 575 | 737 |
| AC911872 | CA915278 | 465 | 673 | CS915277 | 576 | 738 |
| AC911873 | CA915280 | 466 | 674 | CS915279 | 577 | 739 |
| AC911874 | CA915282 | 467 | 621 | CS915281 | 578 | 684 |
| AC912170 | CA915611 | 468 | 662 | CS915255 | 565 | 727 |
| AC912171 | CA915612 | 469 | 662 | CS915255 | 565 | 727 |
| AC912172 | CA915613 | 470 | 662 | CS915255 | 565 | 727 |
| AC912173 | CA915614 | 471 | 662 | CS915255 | 565 | 727 |
| AC912174 | CA915615 | 472 | 662 | CS915255 | 565 | 727 |
| AC912175 | CA915617 | 473 | 662 | CS915616 | 579 | 727 |
| AC912176 | CA915617 | 473 | 662 | CS915618 | 580 | 727 |
| AC912177 | CA915617 | 473 | 662 | CS915619 | 581 | 727 |
| AC912178 | CA915617 | 473 | 662 | CS915255 | 565 | 727 |
| AC912179 | CA915620 | 474 | 755 | CS915255 | 565 | 727 |
| AC912180 | CA915621 | 475 | 662 | CS915255 | 565 | 727 |
| AC912181 | CA915622 | 476 | 665 | CS915261 | 568 | 730 |
| AC912182 | CA915623 | 477 | 665 | CS915261 | 568 | 730 |
| AC912183 | CA915624 | 478 | 665 | CS915261 | 568 | 730 |
| AC912184 | CA915625 | 479 | 665 | CS915261 | 568 | 730 |
| AC912185 | CA915626 | 480 | 665 | CS915261 | 568 | 730 |
| AC912186 | CA915628 | 481 | 665 | CS915627 | 582 | 730 |
| AC912187 | CA915628 | 481 | 665 | CS915629 | 583 | 730 |
| AC912188 | CA915628 | 481 | 665 | CS915630 | 584 | 730 |
| AC912189 | CA915628 | 481 | 665 | CS915261 | 568 | 730 |
| AC912190 | CA915631 | 482 | 756 | CS915261 | 568 | 730 |
| AC912191 | CA915632 | 483 | 665 | CS915261 | 568 | 730 |
| AC912685 | CA916159 | 484 | 665 | CS915261 | 568 | 730 |
| AC912686 | CA916160 | 485 | 665 | CS915261 | 568 | 730 |
| AC912687 | CA916161 | 486 | 665 | CS915261 | 568 | 730 |
| AC912688 | CA916163 | 487 | 618 | CS916162 | 585 | 681 |

TABLE 5A-continued

INHBE RNAi Agents Duplexes with Corresponding Sense and Antisense Strand ID Numbers and Sequence ID numbers for the modified and unmodified nucleotide sequences.

| Duplex ID | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AC912689 | CA916163 | 487 | 618 | CS916164 | 586 | 681 |
| AC912690 | CA916163 | 487 | 618 | CS916165 | 587 | 681 |
| AC912691 | CA915628 | 481 | 665 | CS916166 | 588 | 730 |
| AC912692 | CA916168 | 488 | 752 | CS916167 | 589 | 718 |
| AC912693 | CA916170 | 489 | 675 | CS916169 | 590 | 740 |
| AC912694 | CA916171 | 490 | 657 | CS915245 | 560 | 722 |
| AC912695 | CA916172 | 491 | 657 | CS915245 | 560 | 722 |
| AC912696 | CA916171 | 490 | 657 | CS916173 | 591 | 722 |
| AC912697 | CA916171 | 490 | 657 | CS916174 | 592 | 722 |
| AC912698 | CA916176 | 492 | 616 | CS916175 | 593 | 741 |
| AC912699 | CA916178 | 493 | 617 | CS916177 | 594 | 680 |
| AC912700 | CA916176 | 492 | 616 | CS916179 | 595 | 741 |
| AC912701 | CA916178 | 493 | 617 | CS916180 | 596 | 680 |
| AC912702 | CA916178 | 493 | 617 | CS916181 | 597 | 680 |
| AC912703 | CA916182 | 494 | 617 | CS916177 | 594 | 680 |
| AC912704 | CA916178 | 493 | 617 | CS916183 | 598 | 680 |
| AC912705 | CA916178 | 493 | 617 | CS916184 | 599 | 680 |
| AC912706 | CA916185 | 495 | 664 | CS915259 | 567 | 729 |
| AC912707 | CA916186 | 496 | 664 | CS915259 | 567 | 729 |
| AC912708 | CA916187 | 497 | 757 | CS915259 | 567 | 729 |
| AC912709 | CA916188 | 498 | 664 | CS915259 | 567 | 729 |
| AC912710 | CA916185 | 495 | 664 | CS916189 | 600 | 729 |
| AC912711 | CA916185 | 495 | 664 | CS916190 | 601 | 729 |
| AC912712 | CA916192 | 499 | 620 | CS916191 | 602 | 683 |
| AC912713 | CA916193 | 500 | 620 | CS916191 | 602 | 683 |
| AC912714 | CA916192 | 499 | 620 | CS916194 | 603 | 683 |
| AC912715 | CA916192 | 499 | 620 | CS916195 | 604 | 683 |
| AC912716 | CA916192 | 499 | 620 | CS916196 | 605 | 683 |
| AC912717 | CA916197 | 501 | 621 | CS915281 | 578 | 684 |
| AC912718 | CA916198 | 502 | 621 | CS915281 | 578 | 684 |
| AC912719 | CA916199 | 503 | 621 | CS915281 | 578 | 684 |
| AC912720 | CA916200 | 504 | 621 | CS915281 | 578 | 684 |
| AC912721 | CA916197 | 501 | 621 | CS916201 | 606 | 684 |
| AC912722 | CA916197 | 501 | 621 | CS916202 | 607 | 684 |
| AC912723 | CA916203 | 505 | 676 | CS916201 | 606 | 684 |
| AC912724 | CA916204 | 506 | 621 | CS916201 | 606 | 684 |
| AC912725 | CA916197 | 501 | 621 | CS916205 | 608 | 684 |

TABLE 5B

INHBE RNAi Agents Duplexes with Corresponding Sense and Antisense Strand ID Numbers Referencing Position Targeted on INHBE Gene (SEQ ID NO: 1)

| Duplex ID | Antisense Strand ID | Sense Strand ID | Targeted INHBE Gene Position (Of SEQ ID NO: 1) |
|---|---|---|---|
| AC003824 | CA004695 | CS916167 | 402 |
| AC003825 | CA004697 | CS004696 | 402 |
| AC003826 | CA004698 | CS004696 | 402 |
| AC003827 | CA004699 | CS004696 | 402 |
| AC003828 | CA004700 | CS004696 | 402 |
| AC003829 | CA004701 | CS004696 | 402 |
| AC003830 | CA004700 | CS004702 | 402 |
| AC003831 | CA004703 | CS004696 | 402 |
| AC003832 | CA004704 | CS004696 | 402 |
| AC003833 | CA004705 | CS004696 | 402 |
| AC003834 | CA004700 | CS004706 | 402 |
| AC004005 | CA004911 | CS916175 | 643 |
| AC004006 | CA004912 | CS916177 | 643 |
| AC004007 | CA004912 | CS004913 | 643 |
| AC004008 | CA004914 | CS004913 | 643 |
| AC004009 | CA004915 | CS004913 | 643 |
| AC004045 | CA004973 | CS916162 | 1217 |
| AC004046 | CA004973 | CS004974 | 1217 |
| AC004047 | CA004973 | CS004975 | 1217 |
| AC004053 | CA004985 | CS004984 | N/A |
| AC004117 | CA005092 | CS916191 | 1202 |

TABLE 5B-continued

INHBE RNAi Agents Duplexes with Corresponding Sense and Antisense Strand ID Numbers Referencing Position Targeted on INHBE Gene (SEQ ID NO: 1)

| Duplex ID | Antisense Strand ID | Sense Strand ID | Targeted INHBE Gene Position (Of SEQ ID NO: 1) |
|---|---|---|---|
| AC004118 | CA005092 | CS005093 | 1202 |
| AC004119 | CA005094 | CS916191 | 1202 |
| AC004179 | CA005192 | CS004696 | 402 |
| AC004180 | CA004699 | CS004706 | 402 |
| AC004181 | CA005193 | CS004696 | 402 |
| AC004182 | CA005194 | CS004706 | 402 |
| AC004183 | CA005194 | CS004696 | 402 |
| AC004184 | CA005195 | CS004696 | 402 |
| AC004185 | CA005196 | CS004696 | 402 |
| AC004284 | CA005322 | CS915281 | 2165 |
| AC004285 | CA005322 | CS005323 | 2165 |
| AC004286 | CA005324 | CS915281 | 2165 |
| AC004324 | CA005367 | CS916167 | 402 |
| AC004325 | CA004699 | CS005368 | 402 |
| AC004326 | CA005370 | CS005369 | 402 |
| AC005048 | CA006198 | CS915261 | 1217 |
| AC005049 | CA006199 | CS915259 | 1202 |
| AC005050 | CA006200 | CS916167 | 402 |
| AC005051 | CA006201 | CS915245 | 643 |
| AC005052 | CA006202 | CS915245 | 643 |
| AC005053 | CA006203 | CS915245 | 643 |

TABLE 5B-continued

INHBE RNAi Agents Duplexes with Corresponding Sense and Antisense Strand ID Numbers Referencing Position Targeted on INHBE Gene (SEQ ID NO: 1)

| Duplex ID | Antisense Strand ID | Sense Strand ID | Targeted INHBE Gene Position (Of SEQ ID NO: 1) |
|---|---|---|---|
| AC005809 | CA007066 | CS007065 | 643 |
| AC005810 | CA007067 | CS004913 | 643 |
| AC005811 | CA004912 | CS007068 | 643 |
| AC005812 | CA007069 | CS004913 | 643 |
| AC005813 | CA007070 | CS004913 | 643 |
| AC005814 | CA007071 | CS004913 | 643 |
| AC005817 | CA007075 | CS005323 | 2165 |
| AC005818 | CA005322 | CS007076 | 2165 |
| AC005819 | CA005322 | CS007077 | 2165 |
| AC005820 | CA007078 | CS005323 | 2165 |
| AC005821 | CA005324 | CS005323 | 2165 |
| AC006192 | CA007441 | CS007440 | 530 |
| AC006193 | CA007443 | CS007442 | 637 |
| AC006194 | CA007447 | CS007446 | 883 |
| AC006195 | CA007449 | CS007448 | 1100 |
| AC006196 | CA007455 | CS007454 | 1425 |
| AC006197 | CA007457 | CS007456 | 1430 |
| AC006198 | CA007459 | CS007458 | 1646 |
| AC006199 | CA007461 | CS007460 | 1857 |
| AC006200 | CA007463 | CS007462 | 1861 |
| AC006201 | CA007465 | CS007464 | 1862 |
| AC006202 | CA007467 | CS007466 | 2162 |
| AC006203 | CA007469 | CS007468 | 2163 |
| AC006210 | CA007445 | CS007444 | 709 |
| AC006211 | CA007451 | CS007450 | 1303 |
| AC006212 | CA007453 | CS007452 | 1395 |
| AC006559 | CA007078 | CS007076 | 2165 |
| AC006560 | CA005324 | CS007076 | 2165 |
| AC006561 | CA007078 | CS007077 | 2165 |
| AC006562 | CA005324 | CS007077 | 2165 |
| AC006816 | CA005322 | CS008147 | 2165 |
| AC007393 | CA008796 | CS007456 | 1430 |
| AC007394 | CA007457 | CS008797 | 1430 |
| AC007395 | CA007457 | CS008798 | 1430 |
| AC007396 | CA007457 | CS008799 | 1430 |
| AC007397 | CA007457 | CS008800 | 1430 |
| AC007398 | CA008801 | CS007456 | 1430 |
| AC007399 | CA008802 | CS007456 | 1430 |
| AC007400 | CA008803 | CS007456 | 1430 |
| AC007401 | CA007457 | CS008804 | 1430 |
| AC007402 | CA007457 | CS008805 | 1430 |
| AC007403 | CA007457 | CS008806 | 1430 |
| AC007404 | CA007461 | CS008807 | 1857 |
| AC007405 | CA008808 | CS007460 | 1857 |
| AC007406 | CA008809 | CS007460 | 1857 |
| AC007407 | CA007461 | CS008810 | 1857 |
| AC007408 | CA008811 | CS007460 | 1857 |
| AC007409 | CA007461 | CS008812 | 1857 |
| AC007410 | CA008813 | CS007460 | 1857 |
| AC007411 | CA007461 | CS008814 | 1857 |
| AC007412 | CA007461 | CS008815 | 1857 |
| AC008274 | CA009835 | CS009834 | 1430 |
| AC008275 | CA009837 | CS009836 | 1430 |
| AC008276 | CA009838 | CS009834 | 1430 |
| AC008277 | CA009839 | CS009836 | 1430 |
| AC008278 | CA008803 | CS008797 | 1430 |
| AC008279 | CA008801 | CS008797 | 1430 |
| AC008547 | CA010140 | CS007456 | 1430 |
| AC008888 | CA010516 | CS007456 | 1430 |
| AC008889 | CA009837 | CS010517 | 1430 |
| AC008890 | CA010518 | CS010517 | 1430 |
| AC008891 | CA010520 | CS010519 | 2165 |
| AC008892 | CA010522 | CS010521 | 2165 |
| AC009715 | CA011436 | CS005323 | 2165 |
| AC009757 | CA007636 | CS005323 | 2165 |
| AC009758 | CA007636 | CS007076 | 2165 |
| AC009759 | CA007636 | CS007077 | 2165 |
| AC009760 | CA011474 | CS007456 | 1430 |
| AC009761 | CA011475 | CS005323 | 2165 |
| AC009762 | CA011475 | CS007076 | 2165 |
| AC009763 | CA011475 | CS007077 | 2165 |
| AC911855 | CA915244 | CS915243 | 634 |
| AC911856 | CA915246 | CS915245 | 643 |
| AC911857 | CA915248 | CS915247 | 782 |
| AC911858 | CA915250 | CS915249 | 783 |
| AC911859 | CA915252 | CS915251 | 880 |
| AC911860 | CA915254 | CS915253 | 1037 |
| AC911861 | CA915256 | CS915255 | 1039 |
| AC911862 | CA915258 | CS915257 | 1099 |
| AC911863 | CA915260 | CS915259 | 1202 |
| AC911864 | CA915262 | CS915261 | 1217 |
| AC911865 | CA915264 | CS915263 | 1219 |
| AC911866 | CA915266 | CS915265 | 1348 |
| AC911867 | CA915268 | CS915267 | 1390 |
| AC911868 | CA915270 | CS915269 | 1405 |
| AC911869 | CA915272 | CS915271 | 1428 |
| AC911870 | CA915274 | CS915273 | 1466 |
| AC911871 | CA915276 | CS915275 | 1673 |
| AC911872 | CA915278 | CS915277 | 1674 |
| AC911873 | CA915280 | CS915279 | 1811 |
| AC911874 | CA915282 | CS915281 | 2165 |
| AC912170 | CA915611 | CS915255 | 1039 |
| AC912171 | CA915612 | CS915255 | 1039 |
| AC912172 | CA915613 | CS915255 | 1039 |
| AC912173 | CA915614 | CS915255 | 1039 |
| AC912174 | CA915615 | CS915255 | 1039 |
| AC912175 | CA915617 | CS915616 | 1039 |
| AC912176 | CA915617 | CS915618 | 1039 |
| AC912177 | CA915617 | CS915619 | 1039 |
| AC912178 | CA915617 | CS915255 | 1039 |
| AC912179 | CA915620 | CS915255 | 1039 |
| AC912180 | CA915621 | CS915255 | 1039 |
| AC912181 | CA915622 | CS915261 | 1217 |
| AC912182 | CA915623 | CS915261 | 1217 |
| AC912183 | CA915624 | CS915261 | 1217 |
| AC912184 | CA915625 | CS915261 | 1217 |
| AC912185 | CA915626 | CS915261 | 1217 |
| AC912186 | CA915628 | CS915627 | 1217 |
| AC912187 | CA915628 | CS915629 | 1217 |
| AC912188 | CA915628 | CS915630 | 1217 |
| AC912189 | CA915628 | CS915261 | 1217 |
| AC912190 | CA915631 | CS915261 | 1217 |
| AC912191 | CA915632 | CS915261 | 1217 |
| AC912685 | CA916159 | CS915261 | 1217 |
| AC912686 | CA916160 | CS915261 | 1217 |
| AC912687 | CA916161 | CS915261 | 1217 |
| AC912688 | CA916163 | CS916162 | 1217 |
| AC912689 | CA916163 | CS916164 | 1217 |
| AC912690 | CA916163 | CS916165 | 1217 |
| AC912691 | CA915628 | CS916166 | 1217 |
| AC912692 | CA916168 | CS916167 | 402 |
| AC912693 | CA916170 | CS916169 | 520 |
| AC912694 | CA916171 | CS915245 | 643 |
| AC912695 | CA916172 | CS915245 | 643 |
| AC912696 | CA916171 | CS916173 | 643 |
| AC912697 | CA916171 | CS916174 | 643 |
| AC912698 | CA916176 | CS916175 | 643 |
| AC912699 | CA916178 | CS916177 | 643 |
| AC912700 | CA916176 | CS916179 | 643 |
| AC912701 | CA916178 | CS916180 | 643 |
| AC912702 | CA916178 | CS916181 | 643 |
| AC912703 | CA916182 | CS916177 | 643 |
| AC912704 | CA916178 | CS916183 | 643 |
| AC912705 | CA916178 | CS916184 | 643 |
| AC912706 | CA916185 | CS915259 | 1202 |
| AC912707 | CA916186 | CS915259 | 1202 |
| AC912708 | CA916187 | CS915259 | 1202 |
| AC912709 | CA916188 | CS915259 | 1202 |
| AC912710 | CA916185 | CS916189 | 1202 |
| AC912711 | CA916185 | CS916190 | 1202 |
| AC912712 | CA916192 | CS916191 | 1202 |
| AC912713 | CA916193 | CS916191 | 1202 |
| AC912714 | CA916192 | CS916194 | 1202 |
| AC912715 | CA916192 | CS916195 | 1202 |
| AC912716 | CA916192 | CS916196 | 1202 |
| AC912717 | CA916197 | CS915281 | 2165 |

TABLE 5B-continued

INHBE RNAi Agents Duplexes with Corresponding Sense and Antisense Strand ID Numbers Referencing Position Targeted on INHBE Gene (SEQ ID NO: 1)

| Duplex ID | Antisense Strand ID | Sense Strand ID | Targeted INHBE Gene Position (Of SEQ ID NO: 1) |
|---|---|---|---|
| AC912718 | CA916198 | CS915281 | 2165 |
| AC912719 | CA916199 | CS915281 | 2165 |
| AC912720 | CA916200 | CS915281 | 2165 |
| AC912721 | CA916197 | CS916201 | 2165 |
| AC912722 | CA916197 | CS916202 | 2165 |
| AC912723 | CA916203 | CS916201 | 2165 |
| AC912724 | CA916204 | CS916201 | 2165 |
| AC912725 | CA916197 | CS916205 | 2165 |

INHBE RNAi agent duplex ID AC004053 is an RNAi agent targeted to mouse INHBE.

TABLE 5C

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC003824 | asGfsuuauUfcuggGfaCfgAfcugsgsu | 369 | (NAG37)sasccagucgUfCfCfcagaauaacus(invAb) | 589 |
| AC003825 | usGfsuuauUfcuggGfaCfgAfcugsgsu | 370 | (NAG37)sasccagucgUfCfCfcagaauaacas(invAb) | 507 |
| AC003826 | usGfsuuauUfuuggGfaCfgAfcugsgsu | 371 | (NAG37)sasccagucgUfCfCfcagaauaacas(invAb) | 507 |
| AC003827 | usGfsuuauUfcuggGfaUfgAfcugsgsu | 372 | (NAG37)sasccagucgUfCfCfcagaauaacas(invAb) | 507 |
| AC003828 | usGfsuuauUfcuggGfaCfgAfuugsgsu | 373 | (NAG37)sasccagucgUfCfCfcagaauaacas(invAb) | 507 |
| AC003829 | usGfsuuauUfcuggGfaUfgAfuugsgsu | 374 | (NAG37)sasccagucgUfCfCfcagaauaacas(invAb) | 507 |
| AC003830 | usGfsuuauUfcuggGfaCfgAfuugsgsu | 373 | (NAG37)sasccagucgUfUfCfcagaauaacas(invAb) | 508 |
| AC003831 | usGfsuuauUfuuggGfaCfgAfuugsgsu | 375 | (NAG37)sasccagucgUfCfCfcagaauaacas(invAb) | 507 |
| AC003832 | usGfsuuaudTcuggdGaCfgdAuugsgsu | 376 | (NAG37)sasccagucgUfCfCfcagaauaacas(invAb) | 507 |
| AC003833 | usGfsuuaudTcuggdGaCfgdAdTugsgsu | 377 | (NAG37)sasccagucgUfCfCfcagaauaacas(invAb) | 507 |
| AC003834 | usGfsuuauUfcuggGfaCfgAfuugsgsu | 373 | (NAG37)sasccagucgUfCfCfcagaauaauas(invAb) | 509 |
| AC004005 | usUfscggaAfgaucCfuCfaAfgcaassa | 378 | (NAG37)s(invAb)suuugcuugAfGfGfaucuuccgaas(invAb) | 593 |
| AC004006 | usUfscggaAfgaucCfuCfaAfgcaassu | 379 | (NAG37)s(invAb)sauugcuugAfGfGfaucuuccgaas(invAb) | 594 |
| AC004007 | usUfscggaAfgaucCfuCfaAfgcaassu | 379 | (NAG37)s(invAb)sauugcuugAfgGfAfucuuccgaas(invAb) | 510 |
| AC004008 | usUfscggaAUNAgaucCfuCfaAfgcaassu | 380 | (NAG37)s(invAb)sauugcuugAfgGfAfucuuccgaas(invAb) | 510 |
| AC004009 | cPrpusUfscggaAUNAgaucCfuCfaAfgc aassu | 381 | (NAG37)s(invAb)sauugcuugAfgGfAfucuuccgaas(invAb) | 510 |
| AC004045 | usUfsgaccAfcauuGfcCfaUfuaugssu | 382 | (NAG37)s(invAb)sacauaaugGfCfAfauguggucaas(invAb) | 585 |
| AC004046 | usUfsgaccAfcauuGfcCfaUfuaugssu | 382 | (NAG37)s(invAb)sacauaaugGfcAfAfuguggucaas(invAb) | 511 |
| AC004047 | usUfsgaccAfcauuGfcCfaUfuaugssu | 382 | (NAG37)s(invAb)sacauaaugGfcAfaUfguggucaas(invAb) | 512 |
| AC004053 | usUfsgucuAfugauGfgUfaGfcaaasg | 383 | (NAG37)s(invAb)scuuugcuaCfCfAfucauagacaas(invAb) | 513 |
| AC004117 | usUfsaugaUfccagGfuAfgAfggagssu | 384 | (NAG37)s(invAb)sacuccucuAfCfCfuggaucauaas(invAb) | 602 |
| AC004118 | usUfsaugaUfccagGfuAfgAfggagssu | 384 | (NAG37)s(invAb)sacuccucuAfcCfuGfgaucauaas(invAb) | 514 |
| AC004119 | dTssUfsaugaUfccagGfuAfgAfggagssu | 385 | (NAG37)s(invAb)sacuccucuAfCfCfuggaucauaas(invAb) | 602 |
| AC004179 | usGfsuuauUfcuggGfadTgAfcugsgsu | 386 | (NAG37)sasccagucgUfCfCfcagaauaacas(invAb) | 507 |
| AC004180 | usGfsuuauUfcuggGfaUfgAfcugsgsu | 372 | (NAG37)sasccagucgUfCfCfcagaauaauas(invAb) | 509 |
| AC004181 | usGfsuuauUfcuggGfadTgAfcuggssu | 387 | (NAG37)sasccagucgUfCfCfcagaauaacas(invAb) | 507 |
| AC004182 | usGfsuuauUfcuggGfaUfgAfcuggssu | 388 | (NAG37)sasccagucgUfCfCfcagaauaauas(invAb) | 509 |
| AC004183 | usGfsuuauUfcuggGfaUfgAfcuggssu | 388 | (NAG37)sasccagucgUfCfCfcagaauaacas(invAb) | 507 |

TABLE 5C-continued

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC004184 | usGfsuudAuUfcuggGfaUfgAfcuggssu | 389 | (NAG37)sasccagucgUfCfCfcagaauaacas(invAb) | 507 |
| AC004185 | usGfsuudAuUfcuggGfadTgAfcuggssu | 390 | (NAG37)sasccagucgUfCfCfcagaauaacas(invAb) | 507 |
| AC004284 | usAfsuuAfagaaagUfaUfaAfgccassg | 391 | (NAG37)s(invAb)scuggcuuaUfAfCfuuucuuaauas(invAb) | 578 |
| AC004285 | usAfsuuAfagaaagUfaUfaAfgccassg | 391 | (NAG37)s(invAb)scuggcuuaUfaCfUfuucuuaauas(invAb) | 515 |
| AC004286 | dTssAfsuuAfagaaagUfaUfaAfgccassg | 392 | (NAG37)s(invAb)scuggcuuaUfAfCfuuucuuaauas(invAb) | 578 |
| AC004324 | isGfsuuauUfcuggGfaUfgAfcugsgsu | 393 | (NAG37)sasccagucgUfCfCfcagaauaacus(invAb) | 589 |
| AC004325 | usGfsuuauUfcuggGfaUfgAfcugsgsu | 372 | (NAG37)sasccagucgUfCfCfuagaauaacas(invAb) | 516 |
| AC004326 | usGfsuuauUfcuggGfaUfgAfcugsgsc | 394 | (NAG37)sgsccagucgUfCfCfcagaauaacas(invAb) | 517 |
| AC005048 | usUfsgaccAfcauuGfcCfaUfuaugsi | 395 | (NAG37)s(invAb)sucauaaugGfCfAfauguggucaas(invAb) | 568 |
| AC005049 | usUfsaugaUfccagGfuAfgAfggagsi | 396 | (NAG37)s(invAb)sucuccucuAfCfCfuggaucauaas(invAb) | 567 |
| AC005050 | isGfsuuauUfcuggGfaCfgAfcugsgsu | 397 | (NAG37)sasccagucgUfCfCfcagaauaacus(invAb) | 589 |
| AC005051 | isUfscggaAfgaucCfuCfaAfgcaasa | 398 | (NAG37)s(invAb)suuugcuugAfGfGfaucuuccgaus(invAb) | 560 |
| AC005052 | asUfscggaAfgaucCfuCfaAfgcaasi | 399 | (NAG37)s(invAb)suuugcuugAfGfGfaucuuccgaus(invAb) | 560 |
| AC005053 | isUfscggaAfgaucCfuCfaAfgcaasi | 400 | (NAG37)s(invAb)suuugcuugAfGfGfaucuuccgaus(invAb) | 560 |
| AC005809 | isUfscggaAfgaucCfuCfaAfgcaassu | 401 | (NAG37)s(invAb)sauugcuugAfgGfAfucuuccgaus(invAb) | 518 |
| AC005810 | usUfsuggaAfgaucCfuCfaAfgcaassu | 402 | (NAG37)s(invAb)sauugcuugAfgGfAfucuuccgaas(invAb) | 510 |
| AC005811 | usUfscggaAfgaucCfuCfaAfgcaassu | 379 | (NAG37)s(invAb)sauugcuugAfgGfAfucuucugaas(invAb) | 519 |
| AC005812 | cPrpusUfscggaAfgaucCfuCfaAfgcaassu | 403 | (NAG37)s(invAb)sauugcuugAfgGfAfucuuccgaas(invAb) | 510 |
| AC005813 | dTssUfscggaAfgaucCfuCfaAfgcaassu | 404 | (NAG37)s(invAb)sauugcuugAfgGfAfucuuccgaas(invAb) | 510 |
| AC005814 | usUfscggaAfgaucCfuUfaAfgcaassu | 405 | (NAG37)s(invAb)sauugcuugAfgGfAfucuuccgaas(invAb) | 510 |
| AC005817 | usAfsuuAfaGfaaagUfaUfaAfgccassg | 406 | (NAG37)s(invAb)scuggcuuaUfaCfUfuucuuaauas(invAb) | 515 |
| AC005818 | usAfsuuAfagaaagUfaUfaAfgccassg | 391 | (NAG37)s(invAb)scuggcuuaUfaCfUfuucuuaa_2Nuas (invAb) | 520 |
| AC005819 | usAfsuuAfagaaagUfaUfaAfgccassg | 391 | (NAG37)s(invAb)scuggcuuaUfaCfUfuucuua_2Nauas (invAb) | 521 |
| AC005820 | cPrpusAfsuuAfagaaagUfaUfaAfgc cassg | 407 | (NAG37)s(invAb)scuggcuuaUfaCfUfuucuuaauas(invAb) | 515 |
| AC005821 | dTssAfsuuAfagaaagUfaUfaAfgccassg | 392 | (NAG37)s(invAb)scuggcuuaUfaCfUfuucuuaauas(invAb) | 515 |
| AC006192 | usAfsgcugUfaggcUfgAfaGfuggassg | 408 | (NAG37)s(invAb)scuccacuuCfAfGfccuacaicuas(invAb) | 522 |
| AC006193 | usGfsauccUfcaagCfaAfaGfagugssc | 409 | (NAG37)s(invAb)sgcacucuuUfGfCfuugagiaucas(invAb) | 523 |
| AC006194 | usUfscggaUfcuuaAfgCfuCfuaggssu | 411 | (NAG37)s(invAb)saccuagagCfUfUfaagaucciaas(invAb) | 525 |
| AC006195 | usCfsagaaUfggaaAfgAfgGfcagcssu | 412 | (NAG37)s(invAb)sagcugccuCfUfUfuccauucugas(invAb) | 526 |
| AC006196 | usGfsaaagUfgcccAfuUfuGfggucssc | 415 | (NAG37)s(invAb)sggacccaaAfUfGfggcacuuucas(invAb) | 529 |
| AC006197 | usGfsacaaGfaaagUfgCfcCfauuussg | 416 | (NAG37)s(invAb)scaaaugggCfAfCfuuucuugucas(invAb) | 530 |
| AC006198 | usCfsaucuAfucugCfuUfcCfuccussc | 417 | (NAG37)s(invAb)sgaggaggaAfGfCfagauagaugas(invAb) | 531 |
| AC006199 | usUfsaaauGfcuugUfcUfcCfcagussg | 418 | (NAG37)s(invAb)scacugggaGfAfCfaagcauuua_2Nas(invAb) | 532 |
| AC006200 | usAfsguauAfaaugCfuUfgUfcuccssc | 419 | (NAG37)s(invAb)sgggagacaAfGfCfauuuauacuas(invAb) | 533 |
| AC006201 | usAfsaguaUfaaauGfcUfuGfucucssc | 420 | (NAG37)s(invAb)sggagacaaGfCfAfuuuauacuuas(invAb) | 534 |

TABLE 5C-continued

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC006202 | usAfsagaaAfguauAfaGfcCfaggcssg | 421 | (NAG37)s(invAb)scgccuggcUfUfAfuacuuucuuas(invAb) | 535 |
| AC006203 | usUfsaagaAfaguaUfaAfgCfcaggssc | 422 | (NAG37)s(invAb)sgccuggcuUfAfUfacuuucuuaas(invAb) | 536 |
| AC006210 | usCfsagguUfggugAfuGfuGfgugcssu | 410 | (NAG37)s(invAb)sagcaccacAfUfCfaccaaccugas(invAb) | 524 |
| AC006211 | usCfsaucuUfggucUfcUfuCfacucssc | 413 | (NAG37)s(invAb)sggagugaaGfAfGfaccaagaugas(invAb) | 527 |
| AC006212 | usAfsagugAfgucaUfaUfuGfccagssg | 414 | (NAG37)s(invAb)sccuggcaaUfAfUfgacucacuuas(invAb) | 528 |
| AC006559 | cPrpusAfsuuAfagaaagUfaUfaAfgccassg | 407 | (NAG37)s(invAb)scuggcuuaUfaCfUfuucuuaa_2Nuas(invAb) | 520 |
| AC006560 | dTssAfsuuAfagaaagUfaUfaAfgccassg | 392 | (NAG37)s(invAb)scuggcuuaUfaCfUfuucuuaa_2Nuas(invAb) | 520 |
| AC006561 | cPrpusAfsuuAfagaaagUfaUfaAfgccassg | 407 | (NAG37)s(invAb)scuggcuuaUfaCfUfuucuua_2Nauas(invAb) | 521 |
| AC006562 | dTssAfsuuAfagaaagUfaUfaAfgccassg | 392 | (NAG37)s(invAb)scuggcuuaUfaCfUfuucuua_2Nauas(invAb) | 521 |
| AC006816 | usAfsuuAfagaaagUfaUfaAfgccassg | 391 | (NAG37)s(invAb)scuggcuuaUfaCfUfuucuuaauas(invAb) NH2-C6 | 537 |
| AC007393 | usGfsacAfagaaagUfgCfcCfauuussg | 424 | (NAG37)s(invAb)scaaaugggCfAfCfuuucuugucas(invAb) | 530 |
| AC007394 | usGfsacaaGfaaagUfgCfcCfauuussg | 416 | (NAG37)s(invAb)scaaaugggCfaCfUfuucuugucas(invAb) | 538 |
| AC007395 | usGfsacaaGfaaagUfgCfcCfauuussg | 416 | (NAG37)s(invAb)scaaaugggCfAfCfuuucuuguuas(invAb) | 539 |
| AC007396 | usGfsacaaGfaaagUfgCfcCfauuussg | 416 | (NAG37)s(invAb)scaaaugggCfAfCfuuuuuugucas(invAb) | 540 |
| AC007397 | usGfsacaaGfaaagUfgCfcCfauuussg | 416 | (NAG37)s(invAb)scaaaugggCfAfCfuuucuuiucas(invAb) | 541 |
| AC007398 | cPrpusGfsacaaGfaaagUfgCfcCfauuussg | 425 | (NAG37)s(invAb)scaaaugggCfAfCfuuucuugucas(invAb) | 530 |
| AC007399 | dTssGfacaaGfaaagUfgCfcCfauuussg | 426 | (NAG37)s(invAb)scaaaugggCfAfCfuuucuugucas(invAb) | 530 |
| AC007400 | dTssGfsacaaGfaaagUfgCfcCfauuussg | 427 | (NAG37)s(invAb)scaaaugggCfAfCfuuucuugucas(invAb) | 530 |
| AC007401 | usGfsacaaGfaaagUfgCfcCfauuussg | 416 | (NAG37)s(invAb)sca_2NaaugggCfAfCfuuucuugucas(invAb) | 542 |
| AC007402 | usGfsacaaGfaaagUfgCfcCfauuussg | 416 | (NAG37)s(invAb)scaa_2NaugggCfAfCfuuucuugucas(invAb) | 543 |
| AC007403 | usGfsacaaGfaaagUfgCfcCfauuussg | 416 | (NAG37)s(invAb)scaaa_2NugggCfAfCfuuucuugucas(invAb) | 544 |
| AC007404 | usUfsaaauGfcuugUfcUfcCfcagussg | 418 | (NAG37)s(invAb)scacugggaGfaCfAfagcauuua_2Nas(invAb) | 545 |
| AC007405 | usUfsaaAfugcuugUfcUfcCfcagussg | 428 | (NAG37)s(invAb)scacugggaGfAfCfaagcauuua_2Nas(invAb) | 532 |
| AC007406 | dTssUfsaaauGfcuugUfcUfcCfcagussg | 429 | (NAG37)s(invAb)scacugggaGfAfCfaagcauuua_2Nas(invAb) | 532 |
| AC007407 | usUfsaaauGfcuugUfcUfcCfcagussg | 418 | (NAG37)s(invAb)sca_2NcugggaGfAfCfaagcauuua_2Nas (invAb) | 546 |
| AC007408 | usUfsaaauGfcuugUfcUfcUfcagussg | 430 | (NAG37)s(invAb)scacugggaGfAfCfaagcauuua_2Nas(invAb) | 532 |
| AC007409 | usUfsaaauGfcuugUfcUfcCfcagussg | 418 | (NAG37)s(invAb)scacugigaGfAfCfaagcauuua_2Nas(invAb) | 547 |
| AC007410 | cPrpusUfsaaauGfcuugUfcUfcCfcagussg | 431 | (NAG37)s(invAb)scacugggaGfAfCfaagcauuua_2Nas(invAb) | 532 |
| AC007411 | usUfsaaauGfcuugUfcUfcCfcagussg | 418 | (NAG37)s(invAb)scacugggaGfAfCfaagcauuuaas(invAb) | 548 |
| AC007412 | usUfsaaauGfcuugUfcUfcCfcagussg | 418 | (NAG37)s(invAb)scacugggaGfAfCfaagca_2Nuuuaas(invAb) | 549 |
| AC008274 | dTssGfsacaaGfaaagUfgCfcCfaucussg | 432 | (NAG37)s(invAb)scagaugggCfaCfUfuucuugucas(invAb) | 550 |
| AC008275 | dTssGfsacaaGfaaagUfgCfcCfauucssg | 433 | (NAG37)s(invAb)scgaaugggCfaCfUfuucuugucas(invAb) | 551 |
| AC008276 | cPrpusGfsacaaGfaaagUfgCfcCfaucussg | 434 | (NAG37)s(invAb)scagaugggCfaCfUfuucuugucas(invAb) | 550 |
| AC008277 | cPrpusGfsacaaGfaaagUfgCfcCfauucssg | 435 | (NAG37)s(invAb)scgaaugggCfaCfUfuucuugucas(invAb) | 551 |
| AC008278 | dTssGfsacaaGfaaagUfgCfcCfauuussg | 427 | (NAG37)s(invAb)scaaaugggCfaCfUfuucuugucas(invAb) | 538 |
| AC008279 | cPrpusGfsacaaGfaaagUfgCfcCfauuussg | 425 | (NAG37)s(invAb)scaaaugggCfaCfUfuucuugucas(invAb) | 538 |

TABLE 5C-continued

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC008547 | dTssgsacaagaAfAfGfugcccauuussg | 440 | (NAG37)s(invAb)scaaaugggCfAfCfuuucuugucas(invAb) | 530 |
| AC008888 | dTssGfsacaaGfaaagUfgUfcCfauuussg | 441 | (NAG37)s(invAb)scaaaugggCfAfCfuuucuugucas(invAb) | 530 |
| AC008889 | dTssGfsacaaGfaaagUfgCfcCfauucssg | 433 | (NAG37)s(invAb)scgaaugggCfAfCfuuucuugucas(invAb) | 556 |
| AC008890 | dTssGfsacaaGfaaagUfgUfcCfauucssg | 442 | (NAG37)s(invAb)scgaaugggCfAfCfuuucuugucas(invAb) | 556 |
| AC008891 | usGfsuuAfagaaagUfaUfaAfgccassg | 443 | (NAG37)s(invAb)scuggcuuaUfaCfUfuucuuaacas(invAb) | 557 |
| AC008892 | usAfsuuAfaggaagUfaUfaAfgccassg | 444 | (NAG37)s(invAb)scuggcuuaUfaCfUfuccuuaauas(invAb) | 558 |
| AC009715 | usasuuaagaAfaGfUfauaagccassg | 445 | (NAG37)s(invAb)scuggcuuaUfaCfUfuucuuaauas(invAb) | 515 |
| AC009757 | usAfsuuAfagaaagUfaUfaAfgccasg | 423 | (NAG37)s(invAb)scuggcuuaUfaCfUfuucuuaauas(invAb) | 515 |
| AC009758 | usAfsuuAfagaaagUfaUfaAfgccasg | 423 | (NAG37)s(invAb)scuggcuuaUfaCfUfuucuuaa_2Nuas(invAb) | 520 |
| AC009759 | usAfsuuAfagaaagUfaUfaAfgccasg | 423 | (NAG37)s(invAb)scuggcuuaUfaCfUfuucuua_2Nauas(invAb) | 521 |
| AC009760 | dTssGfsacaaGfaaagUfgCfcCfauuusg | 446 | (NAG37)s(invAb)scaaaugggCfAfCfuuucuugucas(invAb) | 530 |
| AC009761 | cPrpusAfsuuAfagaaagUfaUfaAfgccasg | 447 | (NAG37)s(invAb)scuggcuuaUfaCfUfuucuuaauas(invAb) | 515 |
| AC009762 | cPrpusAfsuuAfagaaagUfaUfaAfgccasg | 447 | (NAG37)s(invAb)scuggcuuaUfaCfUfuucuuaa_2Nuas(invAb) | 520 |
| AC009763 | cPrpusAfsuuAfagaaagUfaUfaAfgccasg | 447 | (NAG37)s(invAb)scuggcuuaUfaCfUfuucuua_2Nauas(invAb) | 521 |
| AC911855 | usCfscsUfcAfagcaaAfgAfgUfgCfcasg | 448 | (NAG37)s(invAb)scuggcacuCfUfUfugcuugaggas(invAb) | 559 |
| AC911856 | asUfscsGfgAfagaucCfuCfaAfgCfaasa | 449 | (NAG37)s(invAb)suuugcuugAfGfGfaucuuccgaus(invAb) | 560 |
| AC911857 | usCfsusAfgUfugcagUfuUfcAfgGfacsa | 450 | (NAG37)s(invAb)suguccugaAfAfCfugcaacuagas(invAb) | 561 |
| AC911858 | usUfscsUfaGfuugcaGfuUfuCfaGfgasc | 451 | (NAG37)s(invAb)sguccugaaAfCfUfgcaacuagaas(invAb) | 562 |
| AC911859 | usGfsasUfcUfuaagcUfcUfaGfgAfagsg | 452 | (NAG37)s(invAb)sccuuccuaGfAfGfcuuaagaucas(invAb) | 563 |
| AC911860 | usAfsgsUfaAfuucagCfuGfgUfaCfccsc | 453 | (NAG37)s(invAb)sgggguaccAfGfCfugaauuacuas(invAb) | 564 |
| AC911861 | usGfscsAfgUfaauucAfgCfuGfgUfacsc | 454 | (NAG37)s(invAb)sgguaccagCfUfGfaauuacugcas(invAb) | 565 |
| AC911862 | usAfsgsAfaUfggaaaGfaGfgCfaGfcasa | 455 | (NAG37)s(invAb)suugcugccUfCfUfuuccauucuas(invAb) | 566 |
| AC911863 | usUfsasUfgAfuccagGfuAfgAfgGfagsa | 456 | (NAG37)s(invAb)sucuccucuAfCfCfuggaucauaas(invAb) | 567 |
| AC911864 | usUfsgsAfcCfacauuGfcCfaUfuAfugsa | 457 | (NAG37)s(invAb)sucauaaugGfCfAfauguggucaas(invAb) | 568 |
| AC911865 | usCfsusUfgAfccacaUfuGfcCfaUfuasu | 458 | (NAG37)s(invAb)sauaauggcAfAfUfguggucaagas(invAb) | 569 |
| AC911866 | usGfsasAfuCfugaugCfcUfcCfaGfucsa | 459 | (NAG37)s(invAb)sugacuggaGfGfCfaucagauucas(invAb) | 570 |
| AC911867 | usAfsgsUfcAfuauugCfcAfgGfuGfgusu | 460 | (NAG37)s(invAb)saaccaccuGfGfCfaauaugacuas(invAb) | 57 |
| AC911868 | usCfsasUfaGfggucAfaGfuGfaGfucsa | 461 | (NAG37)s(invAb)sugacucacUfUfGfaccccuaugas(invAb) | 572 |
| AC911869 | asCfsasAfgAfaagugCfcCfaUfuUfggsg | 462 | (NAG37)s(invAb)scccaaaugGfGfCfacuuucuugus(invAb) | 573 |
| AC911870 | usAfsasCfaCfaucagCfcAfaCfcUfggsa | 463 | (NAG37)s(invAb)succagguuGfGfCfugauguguuas(invAb) | 574 |
| AC911871 | usGfscsUfuAfcccugCfuUfcAfaGfccsu | 464 | (NAG37)s(invAb)saggcuugaAfGfCfaggguaagcas(invAb) | 575 |
| AC911872 | usUfsgsCfuUfacccuGfcUfuCfaAfgcsc | 465 | (NAG37)s(invAb)sggcuugaaGfCfAfggguaagcaas(invAb) | 576 |
| AC911873 | usGfsasAfcUfucuuaGfgCfuUfaGfugsc | 466 | (NAG37)s(invAb)sgcacuaagCfCfUfaagaaguucas(invAb) | 577 |
| AC911874 | usAfsusUfaAfgaaagUfaUfaAfgCfcasg | 467 | (NAG37)s(invAb)scuggcuuaUfAfCfuuucuuaauas(invAb) | 578 |
| AC912170 | usGfscsaGfuaauucAfgCfuGfguacsc | 468 | (NAG37)s(invAb)sgguaccagCfUfGfaauuacugcas(invAb) | 565 |
| AC912171 | usGfscsaguAfauucAfgCfuGfguacsc | 469 | (NAG37)s(invAb)sgguaccagCfUfGfaauuacugcas(invAb) | 565 |
| AC912172 | usGfscsaguAfaUfucagCfuGfguacsc | 470 | (NAG37)s(invAb)sgguaccagCfUfGfaauuacugcas(invAb) | 565 |

TABLE 5C-continued

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC912173 | usGfscsaGfuAUNAaUfucagCfuGfguacsc | 471 | (NAG37)s(invAb)sgguaccagCfUfGfaauuacugcas(invAb) | 565 |
| AC912174 | usGfscsaGfuAUNAauucAfgCfuGfguacsc | 472 | (NAG37)s(invAb)sgguaccagCfUfGfaauuacugcas(invAb) | 565 |
| AC912175 | usGfscaguAfauucAfgCfuGfguacsc | 473 | (NAG37)s(invAb)sgguaccagCfuGfaauuacugcas(invAb) | 579 |
| AC912176 | usGfscaguAfauucAfgCfuGfguacsc | 473 | (NAG37)s(invAb)sgguaccagCfuGfAfauuacugcas(invAb) | 580 |
| AC912177 | usGfscaguAfauucAfgCfuGfguacsc | 473 | (NAG37)s(invAb)sgguaccAfgCfuGfaauuacugcas(invAb) | 581 |
| AC912178 | usGfscaguAfauucAfgCfuGfguacsc | 473 | (NAG37)s(invAb)sgguaccagCfUfGfaauuacugcas(invAb) | 565 |
| AC912179 | dTssGfscaguAfauucAfgCfuGfguacsc | 474 | (NAG37)s(invAb)sgguaccagCfUfGfaauuacugcas(invAb) | 565 |
| AC912180 | cPrpusGfscaguAfauucAfgCfuGfguacsc | 475 | (NAG37)s(invAb)sgguaccagCfUfGfaauuacugcas(invAb) | 565 |
| AC912181 | usUfsgsaCfcacauuGfcCfaUfuaugsa | 476 | (NAG37)s(invAb)sucauaaugGfCfAfauguggucaas(invAb) | 568 |
| AC912182 | usUfsgsaccAfcauuGfcCfaUfuaugsa | 477 | (NAG37)s(invAb)sucauaaugGfCfAfauguggucaas(invAb) | 568 |
| AC912183 | usUfsgsaccAfcAfuugcCfaUfuaugsa | 478 | (NAG37)s(invAb)sucauaaugGfCfAfauguggucaas(invAb) | 568 |
| AC912184 | usUfsgsaCfcAUNACAfuugcCfaUfuaugsa | 479 | (NAG37)s(invAb)sucauaaugGfCfAfauguggucaas(invAb) | 568 |
| AC912185 | usUfsgsaCfcAUNAcauuGfcCfaUfuaugsa | 480 | (NAG37)s(invAb)sucauaaugGfCfAfauguggucaas(invAb) | 568 |
| AC912186 | usUfsgaccAfcauuGfcCfaUfuaugsa | 481 | (NAG37)s(invAb)sucauaaugGfcAfauguggucaas(invAb) | 582 |
| AC912187 | usUfsgaccAfcauuGfcCfaUfuaugsa | 481 | (NAG37)s(invAb)sucauaaugGfcAfAfuguggucaas(invAb) | 583 |
| AC912188 | usUfsgaccAfcauuGfcCfaUfuaugsa | 481 | (NAG37)s(invAb)sucauaaUfgGfcAfauguggucaas(invAb) | 584 |
| AC912189 | usUfsgaccAfcauuGfcCfaUfuaugsa | 481 | (NAG37)s(invAb)sucauaaugGfCfAfauguggucaas(invAb) | 568 |
| AC912190 | dTssUfsgaccAfcauuGfcCfaUfuaugsa | 482 | (NAG37)s(invAb)sucauaaugGfCfAfauguggucaas(invAb) | 568 |
| AC912191 | cPrpusUfsgaccAfcauuGfcCfaUfuaugsa | 483 | (NAG37)s(invAb)sucauaaugGfCfAfauguggucaas(invAb) | 568 |
| AC912685 | usUfsgaccAfcauuGfcCfaUfuaugssa | 484 | (NAG37)s(invAb)sucauaaugGfCfAfauguggucaas(invAb) | 568 |
| AC912686 | usUfsgaccdAcauuGfcCfaUfuaugsa | 485 | (NAG37)s(invAb)sucauaaugGfCfAfauguggucaas(invAb) | 568 |
| AC912687 | usUfsgaccAUNAcauuGfcCfaUfuaugsa | 486 | (NAG37)s(invAb)sucauaaugGfCfAfauguggucaas(invAb) | 568 |
| AC912688 | usUfsgaccAfcauuGfcCfaUfuaugsu | 487 | (NAG37)s(invAb)sacauaaugGfCfAfauguggucaas(invAb) | 585 |
| AC912689 | usUfsgaccAfcauuGfcCfaUfuaugsu | 487 | (NAG37)s(invAb)sacauaaugGfcAfauguggucaas(invAb) | 586 |
| AC912690 | usUfsgaccAfcauuGfcCfaUfuaugsu | 487 | (NAG37)s(invAb)sacauaaUfgGfcAfauguggucaas(invAb) | 587 |
| AC912691 | usUfsgaccAfcauuGfcCfaUfuaugsa | 481 | (NAG37)suscauaaugGfCfAfauguggucaas(invAb) | 588 |
| AC912692 | asdGsuudAudTcuggdGaCfgacuggUscsu | 488 | (NAG37)sasccagucgUfCfCfcagaauaacus(invAb) | 589 |
| AC912693 | asUfsgadAgUUNAggagucUfgUfgacagsusa | 489 | (NAG37)scsugucaCfaGfAfCfuccacuucaus(invAb) | 590 |
| AC912694 | asUfscggaAfgaucCfuCfaAfgcaasa | 490 | (NAG37)s(invAb)suuugcuugAfGfGfaucuuccgaus(invAb) | 560 |
| AC912695 | asUfscggaAfgaucCfuCfaAfgcaassa | 491 | (NAG37)s(invAb)suuugcuugAfGfGfaucuuccgaus(invAb) | 560 |
| AC912696 | asUfscggaAfgaucCfuCfaAfgcaasa | 490 | (NAG37)s(invAb)suuugcuugAfgGfaucuuccgaus(invAb) | 591 |
| AC912697 | asUfscggaAfgaucCfuCfaAfgcaasa | 490 | (NAG37)s(invAb)suuugcuUfgAfgGfaucuuccgaus(invAb) | 592 |
| AC912698 | usUfscggaAfgaucCfuCfaAfgcaasa | 492 | (NAG37)s(invAb)suuugcuugAfGfGfaucuuccgaas(invAb) | 593 |
| AC912699 | usUfscggaAfgaucCfuCfaAfgcaasu | 493 | (NAG37)s(invAb)sauugcuugAfGfGfaucuuccgaas(invAb) | 594 |
| AC912700 | usUfscggaAfgaucCfuCfaAfgcaasa | 492 | (NAG37)s(invAb)suuugcuUfgAfgGfaucuuccgaas(invAb) | 595 |
| AC912701 | usUfscggaAfgaucCfuCfaAfgcaasu | 493 | (NAG37)s(invAb)sauugcuUfgAfgGfaucuuccgaas(invAb) | 596 |
| AC912702 | usUfscggaAfgaucCfuCfaAfgcaasu | 493 | (NAG37)s(invAb)sauugcuugAfgGfaucuuccgaas(invAb) | 597 |

TABLE 5C-continued

INHBE RNAi Agent Duplexes Showing Chemically Modified Antisense Strand and Sense Strand Sequences

| Duplex ID: | Modified Antisense Strand (5' → 3') | SEQ ID NO. | Modified Sense Strand (5' → 3') | SEQ ID NO. |
|---|---|---|---|---|
| AC912703 | cPrpusUfscggaAfgaucCfuCfaAfgcaasu | 494 | (NAG37)s(invAb)sauugcuugAfGfGfaucuuccgaas(invAb) | 594 |
| AC912704 | usUfscggaAfgaucCfuCfaAfgcaasu | 493 | (NAG37)sasuugcuugAfGfGfaucuuccgaas(invAb) | 598 |
| AC912705 | usUfscggaAfgaucCfuCfaAfgcaasu | 493 | (NAG37)sasuugcuugAfgGfaucuuccgaas(invAb) | 599 |
| AC912706 | usUfsaugaUfccagGfuAfgAfggagsa | 495 | (NAG37)s(invAb)sucucccucuAfCfCfuggaucauaas(invAb) | 567 |
| AC912707 | usUfsaugaUfccagGfuAfgAfggagssa | 496 | (NAG37)s(invAb)sucucccucuAfCfCfuggaucauaas(invAb) | 567 |
| AC912708 | usUfsaugadTccagGfuAfgAfggagsa | 497 | (NAG37)s(invAb)sucucccucuAfCfCfuggaucauaas(invAb) | 567 |
| AC912709 | usUfsaugaUUNAccagGfuAfgAfggagsa | 498 | (NAG37)s(invAb)sucucccucuAfCfCfuggaucauaas(invAb) | 567 |
| AC912710 | usUfsaugaUfccagGfuAfgAfggagsa | 495 | (NAG37)s(invAb)sucucccucuAfcCfuggaucauaas(invAb) | 600 |
| AC912711 | usUfsaugaUfccagGfuAfgAfggagsa | 495 | (NAG37)s(invAb)sucucccuCfuAfcCfuggaucauaas(invAb) | 601 |
| AC912712 | usUfsaugaUfccagGfuAfgAfggagsu | 499 | (NAG37)s(invAb)sacucccucuAfCfCfuggaucauaas(invAb) | 602 |
| AC912713 | cPrpusUfsaugaUfccagGfuAfgAfggagsu | 500 | (NAG37)s(invAb)sacucccucuAfCfCfuggaucauaas(invAb) | 602 |
| AC912714 | usUfsaugaUfccagGfuAfgAfggagsu | 499 | (NAG37)sascucccucuAfCfCfuggaucauaas(invAb) | 603 |
| AC912715 | usUfsaugaUfccagGfuAfgAfggagsu | 499 | (NAG37)sascucccucuAfcCfuggaucauaas(invAb) | 604 |
| AC912716 | usUfsaugaUfccagGfuAfgAfggagsu | 499 | (NAG37)sascucccuCfuAfcCfuggaucauaas(invAb) | 605 |
| AC912717 | usAfsuuaaGfaaagUfaUfaAfgccasg | 501 | (NAG37)s(invAb)scuggcuuaUfAfCfuuucuuaauas(invAb) | 578 |
| AC912718 | usAfsuuaaGfaaagUfaUfaAfgccassg | 502 | (NAG37)s(invAb)scuggcuuaUfAfCfuuucuuaauas(invAb) | 578 |
| AC912719 | usAfsuuaadGaaagUfaUfaAfgccasg | 503 | (NAG37)s(invAb)scuggcuuaUfAfCfuuucuuaauas(invAb) | 578 |
| AC912720 | usAfsuuaaGUNAaaagUfaUfaAfgccasg | 504 | (NAG37)s(invAb)scuggcuuaUfAfCfuuucuuaauas(invAb) | 578 |
| AC912721 | usAfsuuaaGfaaagUfaUfaAfgccasg | 501 | (NAG37)s(invAb)scuggcuuaUfaCfuuucuuaauas(invAb) | 606 |
| AC912722 | usAfsuuaaGfaaagUfaUfaAfgccasg | 501 | (NAG37)s(invAb)scuggcuUfaUfaCfuuucuuaauas(invAb) | 607 |
| AC912723 | usAfsuuaaGfaaagUfaUfaAfgucasg | 505 | (NAG37)s(invAb)scuggcuuaUfaCfuuucuuaauas(invAb) | 606 |
| AC912724 | cPrpusAfsuuaaGfaaagUfaUfaAfgccasg | 506 | (NAG37)s(invAb)scuggcuuaUfaCfuuucuuaauas(invAb) | 606 |
| AC912725 | usAfsuuaaGfaaagUfaUfaAfgccasg | 501 | (NAG37)scsuggcuuaUfaCfuuucuuaauas(invAb) | 608 |

In some embodiments, an INHBE RNAi agent is prepared or provided as a salt, mixed salt, or a free-acid. The RNAi agents described herein, upon delivery to a cell expressing an INHBE gene, inhibit or knockdown expression of one or more INHBE genes in vivo and/or in vitro.

Targeting Ligands or Groups, Linking Groups, and Delivery Vehicles

In some embodiments, an INHBE RNAi agent is conjugated to one or more non-nucleotide groups including, but not limited to, a targeting group, a linking group, a targeting ligand, a delivery polymer, or a delivery vehicle. The non-nucleotide group can enhance targeting, delivery or attachment of the RNAi agent. Examples of targeting groups and linking groups are provided in Table 6. The non-nucleotide group can be covalently linked to the 3' and/or 5' end of either the sense strand and/or the antisense strand. In some embodiments, an INHBE RNAi agent contains a non-nucleotide group linked to the 3' and/or 5' end of the sense strand. In some embodiments, a non-nucleotide group is linked to the 5' end of an INHBE RNAi agent sense strand. A non-nucleotide group may be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the RNAi agent or conjugate. In some embodiments, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be monovalent, divalent, trivalent, tetravalent, or have higher valency for the target to which it is directed. Representative targeting groups include, without limitation, compounds with affinity to cell surface molecules, cell receptor ligands, haptens, antibodies, monoclonal antibodies, antibody fragments, and antibody mimics with affinity to cell surface molecules.

In some embodiments, a targeting group is linked to an RNAi agent using a linker, such as a PEG linker or one, two, or three abasic and/or ribitol (abasic ribose) residues, which can in some instances serve as linkers. In some embodiments, a targeting ligand comprises a galactose-derivative cluster.

The INHBE RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

In some embodiments, a targeting group comprises an asialoglycoprotein receptor ligand. As used herein, an asialoglycoprotein receptor ligand is a ligand that contains a moiety having affinity for the asialoglycoprotein receptor. As noted herein, the asialoglycoprotein receptor is highly expressed on hepatocytes. In some embodiments, an asialoglycoprotein receptor ligand includes or consists of one or more galactose derivatives. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formylgalactosamine, N-acetyl-galactosamine, N-propionyl-galactosamine, N-n-butanoyl-galactosamine, and N-iso-butanoylgalactos-amine (see for example: S. T. Iobst and K. Drickamer, J. B. C., 1996, 271, 6686). Galactose derivatives, and clusters of galactose derivatives, that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945).

Galactose derivatives have been used to target molecules to hepatocytes in vivo through their binding to the asialoglycoprotein receptor expressed on the surface of hepatocytes. Binding of asialoglycoprotein receptor ligands to the asialoglycoprotein receptor(s) facilitates cell-specific targeting to hepatocytes and endocytosis of the molecule into hepatocytes. Asialoglycoprotein receptor ligands can be monomeric (e.g., having a single galactose derivative, also referred to as monovalent or monodentate) or multimeric (e.g., having multiple galactose derivatives). The galactose derivative or galactose derivative cluster can be attached to the 3' or 5' end of the sense or antisense strand of the RNAi agent using methods known in the art. The preparation of targeting ligands, such as galactose derivative clusters, is described in, for example, International Patent Application Publication No. WO 2018/044350 to Arrowhead Pharmaceuticals, Inc., and International Patent Application Publication No. WO 2017/156012 to Arrowhead Pharmaceuticals, Inc., the contents of both of which are incorporated by reference herein in their entirety.

As used herein, a galactose derivative cluster comprises a molecule having two to four terminal galactose derivatives. A terminal galactose derivative is attached to a molecule through its C-1 carbon. In some embodiments, the galactose derivative cluster is a galactose derivative trimer (also referred to as tri-antennary galactose derivative or tri-valent galactose derivative). In some embodiments, the galactose derivative cluster comprises N-acetyl-galactosamine moieties. In some embodiments, the galactose derivative cluster comprises three N-acetyl-galactosamine moieties. In some embodiments, the galactose derivative cluster is a galactose derivative tetramer (also referred to as tetra-antennary galactose derivative or tetravalent galactose derivative). In some embodiments, the galactose derivative cluster comprises four N-acetyl-galactosamine moieties.

As used herein, a galactose derivative trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, e.g., U.S. Pat. No. 5,885,968; Biessen et al. J. Med. Chem. 1995 Vol. 39 p. 1538-1546). In some embodiments, the PEG spacer is a PEG3 spacer. The branch point can be any small molecule which permits attachment of three galactose derivatives and further permits attachment of the branch point to the RNAi agent. An example of branch point group is a di-lysine or di-glutamate. Attachment of the branch point to the RNAi agent can occur through a linker or spacer. In some embodiments, the linker or spacer comprises a flexible hydrophilic spacer, such as, but not limited to, a PEG spacer. In some embodiments, the linker comprises a rigid linker, such as a cyclic group. In some embodiments, a galactose derivative comprises or consists of N-acetyl-galactosamine. In some embodiments, the galactose derivative cluster is comprised of a galactose derivative tetramer, which can be, for example, an N-acetyl-galactosamine tetramer.

Certain embodiments of the present disclosure include pharmaceutical compositions for delivering an INHBE RNAi agent to a liver cell in vivo. Such pharmaceutical compositions can include, for example, an INHBE RNAi agent conjugated to a galactose derivative cluster. In some embodiments, the galactose derivative cluster is comprised of a galactose derivative trimer, which can be, for example, an N-acetyl-galactosamine trimer, or galactose derivative tetramer, which can be, for example, an N-acetyl-galactosamine tetramer.

A targeting ligand or targeting group can be linked to the 3' or 5' end of a sense strand or an antisense strand of an INHBE RNAi agent disclosed herein.

Targeting ligands include, but are not limited to (NAG37) and (NAG37)s as defined in Table 6. Other targeting groups and targeting ligands, including galactose cluster targeting ligands, are known in the art.

In some embodiments, a linking group is conjugated to the RNAi agent. The linking group facilitates covalent linkage of the agent to a targeting group, delivery polymer, or delivery vehicle. The linking group can be linked to the 3' and/or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, can include, but are not limited to: reactive groups such a primary amines and alkynes, alkyl groups, abasic nucleotides, ribitol (abasic ribose), and/or PEG groups.

In some embodiments, a targeting group is linked internally to a nucleotide on the sense strand and/or the antisense strand of the RNAi agent. In some embodiments, a targeting group is linked to the RNAi agent via a linker.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage can optionally include a spacer that increases the distance between the two joined atoms. A spacer can further add flexibility and/or length to the linkage. Spacers include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

In some embodiments, when two or more RNAi agents are included in a single composition, each of the RNAi agents may be linked to the same targeting group or two a different targeting groups (i.e., targeting groups having different chemical structure). In some embodiments, targeting groups are linked to the INHBE RNAi agents disclosed herein without the use of an additional linker. In some embodiments, the targeting group itself is designed having a linker or other site to facilitate conjugation readily present. In some embodiments, when two or more INHBE RNAi agents are included in a single molecule, each of the RNAi agents may utilize the same linker or different linkers (i.e., linkers having different chemical structures).

Any of the INHBE RNAi agent nucleotide sequences listed in Tables 2, 3, 4, or 5C, whether modified or unmodified, can contain 3' and/or 5' targeting group(s) or linking group(s). Any of the INHBE RNAi agent sequences listed in Table 3 or 4, or are otherwise described herein, which contain a 3' or 5' targeting group or linking group, can alternatively contain no 3' or 5' targeting group or linking group, or can contain a different 3' or 5' targeting group or linking group including, but not limited to, those depicted in Table 6. Any of the INHBE RNAi agent duplexes listed in Tables 5A, 5B and 5C, whether modified or unmodified, can further comprise a targeting group or linking group, including, but not limited to, those depicted in Table 6, and the targeting group or linking group can be attached to the 3' or 5' terminus of either the sense strand or the antisense strand of the INHBE RNAi agent duplex.

Examples of targeting groups and linking groups (which when combined can form targeting ligands) are provided in Table 6. Table 4 and Table 5C provide several embodiments of INHBE RNAi agent sense strands having a targeting group or linking group linked to the 5' or 3' end.

TABLE 6

Structures Representing Various Modified Nucleotides, Targeting Ligands or Targeting Groups, Capping Residues, and Linking Groups

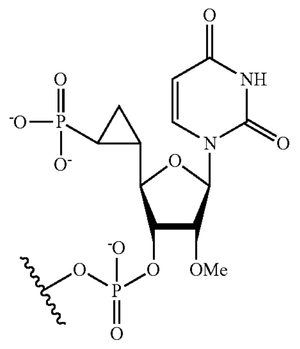

cPrpu

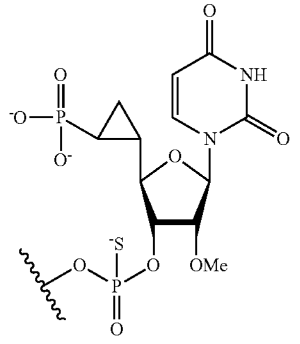

cPrpus

TABLE 6-continued
| Structures Representing Various Modified Nucleotides, Targeting Ligands or Targeting Groups, Capping Residues, and Linking Groups |
| --- |
| 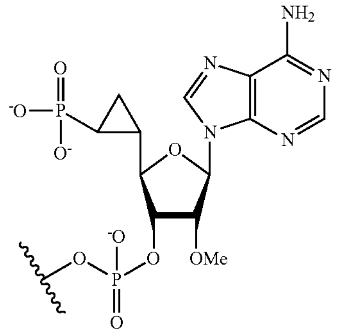 |
| cPrpa |
| 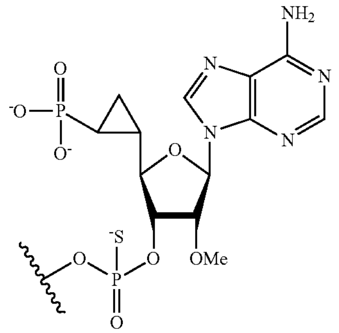 |
| cPrpas |
| 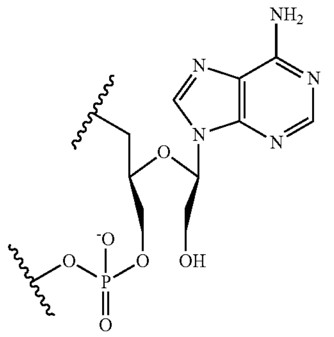 |
| AUNA |
| 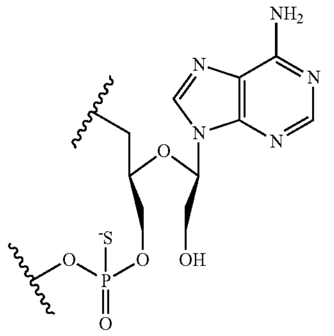 |
| AUNAS |

TABLE 6-continued
| Structures Representing Various Modified Nucleotides, Targeting Ligands or Targeting Groups, Capping Residues, and Linking Groups |
|---|
| 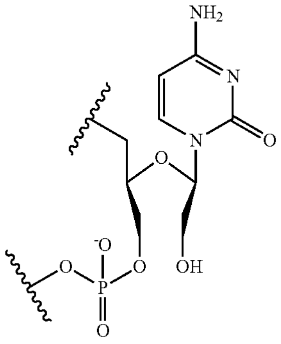 |
| CUNA |
| 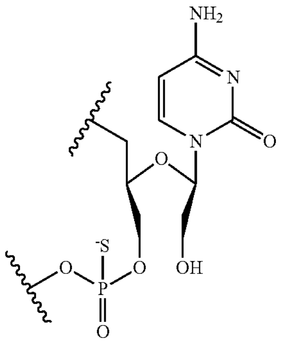 |
| CUNAS |
| 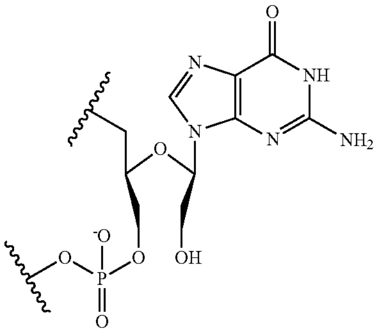 |
| GUNA |
| 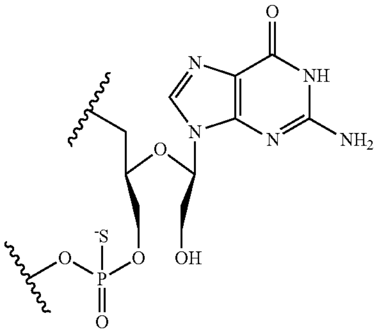 |
| GUNAS |

TABLE 6-continued
| Structures Representing Various Modified Nucleotides, Targeting Ligands or Targeting Groups, Capping Residues, and Linking Groups |
|---|
| 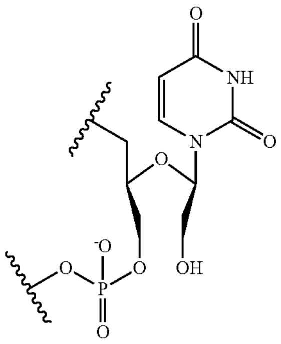 |
| UUNA |
| 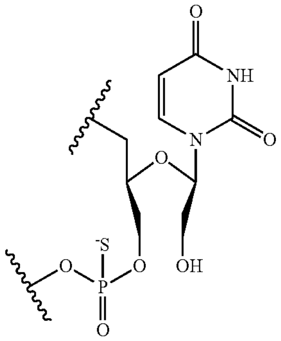 |
| UUNAS |
| 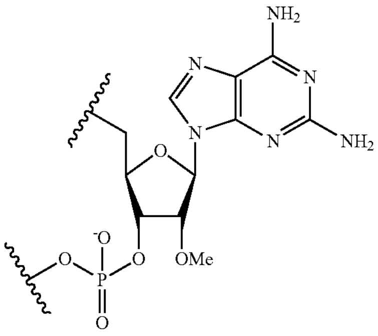 |
| a_2N |
| 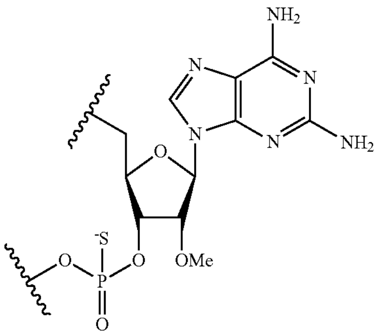 |
| a_2Ns |

TABLE 6-continued
Structures Representing Various Modified Nucleotides, Targeting Ligands or Targeting Groups, Capping Residues, and Linking Groups
When positioned internally:
linkage towards 5′ end
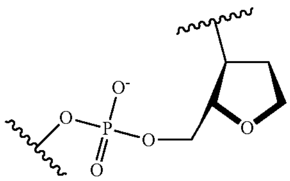
linkage towards 3′ end
(invAb)
linkage towards 5′ end
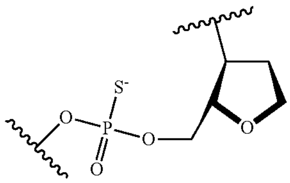
linkage towards 3′ end
(invAb)s
When positioned at the 3' terminal end:
linkage towards 5′ end
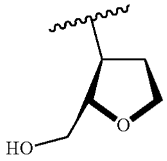
(invAb)
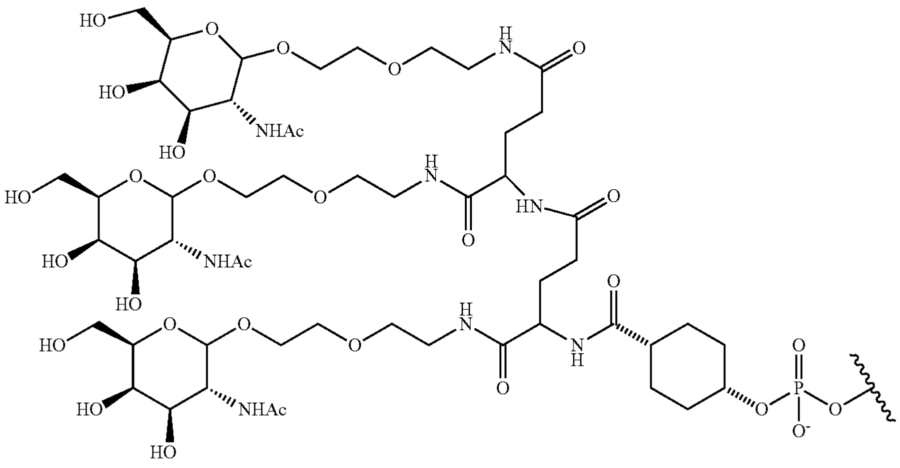
(NAG37)

TABLE 6-continued

Structures Representing Various Modified Nucleotides, Targeting Ligands or Targeting Groups, Capping Residues, and Linking Groups

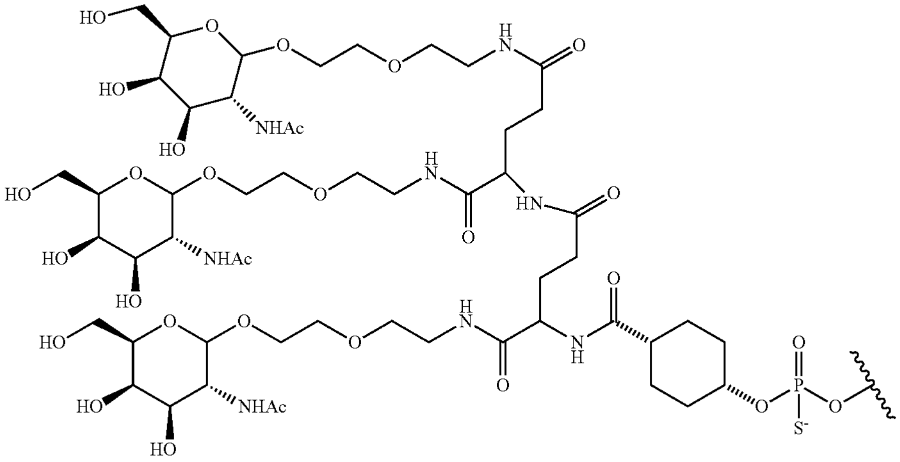

(NAG37)s

Other linking groups known in the art may be used.

In some embodiments, a delivery vehicle can be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine. In some embodiments, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see, for example WO 2000/053722, WO 2008/0022309, WO 2011/104169, and WO 2012/083185, WO 2013/032829, WO 2013/158141, each of which is incorporated herein by reference), hydrogels, cyclodextrins, biodegradable nanocapsules, and bioadhesive microspheres, proteinaceous vectors, or other delivery systems suitable for nucleic acid or oligonucleotide delivery as known and available in the art.

Pharmaceutical Compositions and Formulations

The INHBE RNAi agents disclosed herein can be prepared as pharmaceutical compositions or formulations (also referred to herein as "medicaments"). In some embodiments, pharmaceutical compositions include at least one INHBE RNAi agent. These pharmaceutical compositions are particularly useful in the inhibition of the expression of the target mRNA in a target cell, a group of cells, a tissue, or an organism.

The pharmaceutical compositions can be used to treat a subject having a disease, disorder, or condition that would benefit from reduction in the level of the target INHBE mRNA, or inhibition in expression of the target gene. The pharmaceutical compositions can be used to treat a subject at risk of developing a disease, disorder, symptom, or condition that would benefit from reduction of the level of the target mRNA or an inhibition in expression the target gene. In one embodiment, the method includes administering an INHBE RNAi agent linked to a targeting ligand as described herein, to a subject to be treated. In some embodiments, one or more pharmaceutically acceptable excipients (including vehicles, carriers, diluents, and/or delivery polymers) are added to the pharmaceutical compositions that include an INHBE RNAi agent, thereby forming a pharmaceutical formulation or medicament suitable for in vivo delivery to a subject, including a human.

The pharmaceutical compositions that include an INHBE RNAi agent and methods disclosed herein decrease the level of the target mRNA in a cell, group of cells, group of cells, tissue, organ, or subject, including by administering to the subject a therapeutically effective amount of a herein described INHBE RNAi agent, thereby inhibiting the expression of INHBE mRNA in the subject. In some embodiments, the subject has been previously identified as having a pathogenic upregulation of the target gene in hepatocytes. In some embodiments, the subject has been previously identified or diagnosed as having obesity, diabetes, liver inflammation, dyslipidemia, or metabolic disease. In some embodiments, the subject has been suffering from symptoms associated with diseases such as obesity, diabetes, liver inflammation, dyslipidemia, or metabolic disease. In some embodiments, the subject would benefit from a reduction of INHBE gene expression in the subject's liver.

In some embodiments, the described pharmaceutical compositions including an INHBE RNAi agent are used for treating or managing clinical presentations associated with obesity, diabetes, liver inflammation, dyslipidemia, or metabolic disease. In some embodiments, a therapeutically (including prophylactically) effective amount of one or more of pharmaceutical compositions is administered to a subject in need of such treatment. In some embodiments, administration of any of the disclosed INHBE RNAi agents can be used to decrease the number, severity, and/or frequency of symptoms of a disease in a subject.

In some embodiments, the subject is administered a therapeutically effective amount of one or more pharmaceutical compositions that include an INHBE RNAi agent thereby treating the symptom. In other embodiments, the subject is administered a prophylactically effective amount of one or more INHBE RNAi agents, thereby preventing or inhibiting the at least one symptom.

The route of administration is the path by which an INHBE RNAi agent is brought into contact with the body. In general, methods of administering drugs and oligonucleotides and nucleic acids for treatment of a mammal are well known in the art and can be applied to administration of the compositions described herein. The INHBE RNAi agents disclosed herein can be administered via any suitable route in a preparation appropriately tailored to the particular route. Thus, herein described pharmaceutical compositions can be administered by injection, for example, intravenously, intramuscularly, intracutaneously, subcutaneously, intraarticularly, or intraperitoneally. In some embodiments, the herein described pharmaceutical compositions are administered via subcutaneous injection.

The pharmaceutical compositions including an INHBE RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intramuscular, transdermal, airway (aerosol), nasal, oral, rectal, or topical (including buccal and sublingual) administration. In certain embodiments, the compositions are administered by subcutaneous or intravenous infusion or injection.

In some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., INHBE RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® EL™ (BASF, Parsippany, NJ) or phosphate buffered saline (PBS). Suitable carriers should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle, which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

In some embodiments, pharmaceutical formulations that include the INHBE RNAi agents disclosed herein suitable for subcutaneous administration can be prepared in an aqueous sodium phosphate buffer (e.g., the INHBE RNAi agent formulated in 0.5 mM sodium phosphate monobasic, 0.5 mM sodium phosphate dibasic, in water). In some embodiments, pharmaceutical formulations that include the INHBE RNAi agents disclosed herein suitable for subcutaneous administration can be prepared in water for injection (sterile water). INHBE RNAi agents disclosed herein suitable for subcutaneous administration can be prepared in isotonic saline (0.9%).

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

Formulations suitable for oral administration of the INHBE RNAi agents disclosed herein can also be prepared. In some embodiments, the INHBE RNAi agents disclosed herein are administered orally. In some embodiments, the INHBE RNAi agents disclosed herein are formulated in a capsule for oral administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The INHBE RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, analgesics, antihistamines, or anti-inflammatory agents (e.g., acetaminophen, NSAIDs, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some embodiments, the methods disclosed herein further comprise the step of administering a second therapeutic or treatment in addition to administering an RNAi agent disclosed herein. In some embodiments, the second therapeutic is another INHBE RNAi agent (e.g., an INHBE RNAi agent that targets a different sequence within the INHBE target). In other embodiments, the second therapeutic can be a small molecule drug, an antibody, an antibody fragment, or an aptamer.

In some embodiments, the described INHBE RNAi agent(s) are optionally combined with one or more additional therapeutics. The INHBE RNAi agent and additional therapeutic(s) can be administered in a single composition or they can be administered separately. In some embodiments, the one or more additional therapeutics is administered separately in separate dosage forms from the RNAi agent (e.g., the INHBE RNAi agent is administered by subcutaneous injection, while the additional therapeutic involved in the method of treatment dosing regimen is administered orally). In some embodiments, the described INHBE RNAi agent(s) are administered to a subject in need thereof via subcutaneous injection, and the one or more optional additional therapeutics are administered orally, which together provide for a treatment regimen for diseases and conditions associated with obesity, diabetes, liver inflammation, dyslipidemia, or metabolic disease. In some embodiments, the described INHBE RNAi agent(s) are administered to a subject in need thereof via subcutaneous injection, and the one or more optional additional therapeutics are administered via a separate subcutaneous injection. In some embodiments, the INHBE RNAi agent and one or more additional therapeutics are combined into a single dosage form (e.g., a "cocktail" formulated into a single composition for subcutaneous injection). The INHBE RNAi agents, with or without the one or more additional therapeutics, can be combined with one or more excipients to form pharmaceutical compositions. In some embodiments, the INHBE RNAi agents may be combined with glucagon-like peptide-1 (GLP-1) agonists. In some embodiments, the GLP-1 agonist may be selected from Dulaglutide, Tirzepatide, Exenatide, Semaglutide, Liraglutide, and Lixisenatide.

Generally, an effective amount of an INHBE RNAi agent will be in the range of from about 0.1 to about 100 mg/kg of body weight/dose, e.g., from about 1.0 to about 50 mg/kg of body weight/dose. In some embodiments, an effective amount of an active compound will be in the range of from about 0.25 to about 5 mg/kg of body weight per dose. In some embodiments, an effective amount of an active ingredient will be in the range of from about 0.5 to about 4 mg/kg of body weight per dose. In some embodiments, an effective amount of an INHBE RNAi agent may be a fixed dose. In some embodiments, the fixed dose is in the range of from about 5 mg to about 1,000 mg of INHBE RNAi agent. In some embodiments, the fixed does is in the range of 50 to 400 mg of INHBE RNAi agent. Dosing may be weekly, bi-weekly, monthly, quarterly, or at any other interval depending on the dose of INHBE RNAi agent administered, the activity level of the particular INHBE RNAi agent, and the desired level of inhibition for the particular subject. The Examples herein show suitable levels for inhibition in certain animal species. The amount administered will depend on such variables as the overall health status of the patient or subject, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum.

For treatment of disease or for formation of a medicament or composition for treatment of a disease, the pharmaceutical compositions described herein including an INHBE RNAi agent can be combined with an excipient or with a second therapeutic agent or treatment including, but not limited to: a second or other RNAi agent, a small molecule drug, an antibody, an antibody fragment, peptide and/or an aptamer.

The described INHBE RNAi agents, when added to pharmaceutically acceptable excipients or adjuvants, can be packaged into kits, containers, packs, or dispensers. The pharmaceutical compositions described herein may be packaged in pre-filled syringes, pen injectors, autoinjectors, infusion bags/devices, or vials.

Methods of Treatment and Inhibition of Expression

The INHBE RNAi agents disclosed herein can be used to treat a subject (e.g., a human or other mammal) having a disease or disorder that would benefit from administration of the RNAi agent. In some embodiments, the RNAi agents disclosed herein can be used to treat a subject (e.g., a human) that would benefit from reduction and/or inhibition in expression of INHBE mRNA and/or INHBE protein levels, a subject that has been diagnosed with or is suffering from symptoms related to diseases such as obesity, diabetes, liver inflammation, dyslipidemia, or metabolic disease.

In some embodiments, the subject is administered a therapeutically effective amount of any one or more INHBE RNAi agents. Treatment of a subject can include therapeutic and/or prophylactic treatment. The subject is administered a therapeutically effective amount of any one or more INHBE RNAi agents described herein. The subject can be a human, patient, or human patient. The subject may be an adult, adolescent, child, or infant. Administration of a pharmaceutical composition described herein can be to a human being or animal.

The INHBE RNAi agents described herein can be used to treat at least one symptom in a subject having an INHBE-related disease or disorder, or having a disease or disorder that is mediated at least in part by INHBE gene expression. In some embodiments, the INHBE RNAi agents are used to treat or manage a clinical presentation of a subject with a disease or disorder that would benefit from or be mediated at least in part by a reduction in INHBE mRNA. The subject is administered a therapeutically effective amount of one or more of the INHBE RNAi agents or INHBE RNAi agent-containing compositions described herein. In some embodiments, the methods disclosed herein comprise administering a composition comprising an INHBE RNAi agent described herein to a subject to be treated. In some embodiments, the subject is administered a prophylactically effective amount of any one or more of the described INHBE RNAi agents, thereby treating the subject by preventing or inhibiting the at least one symptom.

In certain embodiments, the present disclosure provides methods for treatment of diseases, disorders, conditions, or pathological states mediated at least in part by INHBE gene expression, in a patient in need thereof, wherein the methods include administering to the patient any of the INHBE RNAi agents described herein.

In some embodiments, the 5' end of the sense strand is coupled to a targeting ligand comprising the structure of (NAG37)s.

In some embodiments, the gene expression level and/or mRNA level of an INHBE gene in a subject to whom a described INHBE RNAi agent is administered is reduced by at least about 30%, 35%, 40%, 45%, 50%, 55%, 60%, 65%, 70%, 75%, 80%, 85%, 95%, 96%, 97%, 98%, 99%, or greater than 99% relative to the subject prior to being administered the INHBE RNAi agent or to a subject not receiving the INHBE RNAi agent. The gene expression level and/or mRNA level in the subject may be reduced in a cell, group of cells, and/or tissue of the subject. In some embodiments, the INHBE gene expression is inhibited by at least about 30%, 35%, 40%, 45% 50%, 55%, 60%, 65%, or greater than 65% in the cytoplasm of hepatocytes relative to the subject prior to being administered the INHBE RNAi agent or to a subject not receiving the INHBE RNAi agent.

In some embodiments, the INHBE protein expression level in a subject to whom a described INHBE RNAi agent has been administered is reduced by at least about 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the INHBE RNAi agent or to a subject not receiving the INHBE RNAi agent. The protein expression level in the subject may be reduced in a cell, group of cells, tissue, blood, and/or other fluid of the subject.

A reduction in INHBE mRNA expression levels and INHBE protein expression levels can be assessed by any methods known in the art. As used herein, a reduction or decrease in INHBE mRNA level and/or protein level are collectively referred to herein as a reduction or decrease in INHBE or inhibiting or reducing the gene expression of INHBE. The Examples set forth herein illustrate known methods for assessing inhibition of INHBE gene expression. The person of ordinary skill in the art would further know suitable methods for assessing inhibition of INHBE gene expression in vivo and/or in vitro.

In some embodiments, disclosed herein are methods of treatment (including prophylactic or preventative treatment) of diseases, disorders, or symptoms caused by diseases such as obesity, diabetes, liver inflammation, dyslipidemia, or metabolic disease, wherein the methods include administering to a subject in need thereof a therapeutically effective amount of an INHBE RNAi agent that includes an antisense strand that is at least partially complementary to the portion of the INHBE mRNA having the sequence in Table 1. In some embodiments, disclosed herein are methods of treatment (including prophylactic or preventative treatment) of diseases or symptoms caused by diseases such as obesity, diabetes, liver inflammation, dyslipidemia, or metabolic disease, wherein the methods include administering to a subject in need thereof a therapeutically effective amount of an INHBE RNAi agent that includes an antisense strand comprising the sequence of any of the sequences in Tables 2, 3 or 5C, and a sense strand that comprises any of the sequences in Tables 2, 4, or 5C that is at least partially complementary to the antisense strand. In some embodiments, disclosed herein are methods of treatment (including prophylactic or preventative treatment) of diseases or symptoms caused by diseases such as obesity, diabetes, liver inflammation, dyslipidemia, or metabolic disease, wherein the methods include administering to a subject in need thereof a therapeutically effective amount of an INHBE RNAi agent that includes a sense strand that comprises any of the sequences in Tables 2, 4, or 5C, and an antisense strand comprising the sequence of any of the sequences in Tables 2, 3, or 5C that is at least partially complementary to the sense strand.

In some embodiments, the 5' end of the sense strand is coupled to a targeting ligand comprising the structure of (NAG37)s.

In some embodiments, disclosed herein are methods for inhibiting expression of an INHBE gene in a cell, wherein the methods include administering to the cell an INHBE RNAi agent that includes an antisense strand that is at least partially complementary to the portion of the INHBE mRNA having the sequence in Table 1. In some embodiments, disclosed herein are methods of inhibiting expression of an INHBE gene in a cell, wherein the methods include administering to a cell an INHBE RNAi agent that includes an antisense strand comprising the sequence of any of the sequences in Tables 2, 3, or 5C and a sense strand that comprises any of the sequences in Tables 2, 4, or 5C that is at least partially complementary to the antisense strand. In some embodiments, disclosed herein are methods of inhibiting expression of an INHBE gene in a cell, wherein the methods include administering an INHBE RNAi agent that includes a sense strand that comprises any of the sequences in Tables 2, 4, or 5C, and an antisense strand that includes the sequence of any of the sequences in Tables 2, 3, or 5C that is at least partially complementary to the sense strand.

In some embodiments, the INHBE RNAi agents are administered to a subject in need thereof as a first line therapy. In some embodiments, the INHBE RNAi agents are administered to a subject in need thereof as a second line therapy. In certain embodiments, the INHBE RNAi agents are administered as a second line therapy to patients who have failed one or more first line standard of care therapies. In certain embodiments, the INHBE RNAi agents are administered as a maintenance therapy following the administration of one or more prior therapies. In certain embodiments, the INHBE RNAi agents administered as a maintenance therapy following the administration of one or more standard of care therapies. In some embodiments, the INHBE RNAi agents administered in combination with one or more additional therapies. In some embodiments, the one or more additional therapies is a standard of care therapy. In some embodiments, the one or more additional therapies is an oral therapy.

The use of INHBE RNAi agents provides methods for therapeutic (including prophylactic) treatment of diseases/disorders associated with diseases such as obesity, diabetes, liver inflammation, dyslipidemia, or metabolic disease, or elevated INHBE gene expression. The described INHBE RNAi agents mediate RNA interference to inhibit the expression of one or more genes necessary for production of INHBE protein. INHBE RNAi agents can also be used to treat or prevent various diseases, disorders, or conditions, including diseases such as obesity, diabetes, liver inflammation, dyslipidemia, or metabolic disease. Furthermore, compositions for delivery of INHBE RNAi agents to liver cells, and specifically to hepatocytes, in vivo, are described.

Cells, Tissues, Organs, and Non-Human Organisms

Cells, tissues, organs, and non-human organisms that include at least one of the INHBE RNAi agents described herein are contemplated. The cell, tissue, organ, or non-human organism is made by delivering the RNAi agent to the cell, tissue, organ or non-human organism.

Illustrative Embodiments

Provided here are illustrative embodiments of the disclosed technology. These embodiments are illustrative only and do not limit the scope of the present disclosure or of the claims attached hereto.

Embodiment 1. An RNAi agent for inhibiting expression of an Inhibin Subunit Beta E (INHBE) gene, comprising:
- i. an antisense strand comprising at least 17 contiguous nucleotides differing by 0 or 1 nucleotides from any one of the sequences of Table 2, Table 3, or Table 5C; and
- ii. a sense strand comprising a nucleotide sequence that is at least partially complementary to the antisense strand.

Embodiment 2. The RNAi agent of embodiment 1, wherein the antisense strand comprises nucleotides 2-18 of any one of the sequences of Table 2, Table 3, or Table 5C.

Embodiment 3. The RNAi agent of embodiment 1 or embodiment 2, wherein the sense strand comprises a nucleotide sequence of at least 15 contiguous nucleotides differing by 0 or 1 nucleotides from 15 contiguous nucleotides of any one of the sense strand sequences of Table 2, Table 4, or Table 5C, and wherein the sense strand has a region of at least 85% complementarity over the 17 contiguous nucleotides to the antisense strand.

Embodiment 4. The RNAi agent of any one of embodiments 1-3, wherein at least one nucleotide of the RNAi agent is a modified nucleotide or includes a modified internucleoside linkage.

Embodiment 5. The RNAi agent of any one of embodiments 1-3, wherein all or substantially all of the nucleotides of the sense and/or antisense strand of the RNAi agent are modified nucleotides.

Embodiment 6. The RNAi agent of any one of embodiments 4-5, wherein the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholine nucleotide, vinyl phosphonate containing nucleotide, cyclopropyl phosphonate containing nucleotide, and 3'-O-methyl nucleotide.

Embodiment 7. The RNAi agent of embodiment 5, wherein all or substantially all of the modified nucleotides are 2'-O-methyl nucleotides, 2'-fluoro nucleotides, or combinations thereof.

Embodiment 8. The RNAi agent of any one of embodiments 1-7, wherein the antisense strand consists of, consists essentially of, or comprises the nucleotide sequence of any one of the modified antisense strand sequences of Table 3 or Table 5C.

Embodiment 9. The RNAi agent of any one of embodiments 1-8, wherein the sense strand consists of, consists essentially of, or comprises the nucleotide sequence of any of the modified sense strand sequences of Table 4 or Table 5C.

Embodiment 10. The RNAi agent of embodiment 1, wherein the antisense strand comprises the nucleotide sequence of any one of the modified sequences of Table 3 or Table 5C and the sense strand comprises the nucleotide sequence of any one of the modified sequences of Table 4 or Table 5C.

Embodiment 11. The RNAi agent of any one of embodiments 1-10, wherein the RNAi agent is linked to a targeting ligand.

Embodiment 12. The RNAi agent of any one of embodiments 1-11, wherein the targeting ligand has affinity for the asialoglycoprotein receptor.

Embodiment 13. The RNAi agent of embodiment 11 or 12, wherein the targeting ligand comprises N-acetyl-galactosamine.

Embodiment 14. The RNAi agent of any one of embodiments 11-13, wherein the targeting ligand comprises the structure of (NAG37) or (NAG37)s.

Embodiment 15. The RNAi agent of any one of embodiments 11-14, wherein the targeting ligand is linked to the sense strand.

Embodiment 16. The RNAi agent of embodiment 15, wherein the targeting ligand is linked to the 5' terminal end of the sense strand.

Embodiment 17. The RNAi agent of any one of embodiments 1-16, wherein the sense strand is between 15 and 30 nucleotides in length, and the antisense strand is between 18 and 30 nucleotides in length.

Embodiment 18. The RNAi agent of embodiment 17, wherein the sense strand and the antisense strand are each between 18 and 27 nucleotides in length.

Embodiment 19. The RNAi agent of embodiment 18, wherein the sense strand and the antisense strand are each between 18 and 24 nucleotides in length.

Embodiment 20. The RNAi agent of embodiment 19, wherein the sense strand and the antisense strand are each 21 nucleotides in length.

Embodiment 21. The RNAi agent of any one of embodiments 1-20, wherein the RNAi agent has two blunt ends.

Embodiment 22. The RNAi agent of any one of embodiments 1-21, wherein the sense strand comprises one or two terminal caps.

Embodiment 23. The RNAi agent of any one of embodiments 1-22, wherein the sense strand comprises one or two inverted abasic residues.

Embodiment 24. The RNAi agent of embodiment 1, wherein the RNAi agent is comprised of a sense strand and an antisense strand that form a duplex sequence of any of the duplexes set forth in Table 5A, 5B, or 5C.

Embodiment 25. The RNAi agent of any one of embodiments 1-24, wherein the sense strand includes inverted abasic residues at the 3' terminal end of the nucleotide sequence, at the 5' end of the nucleotide sequence, or at both.

Embodiment 26. The RNAi agent of embodiment 1, comprising an antisense strand that consists of, consists essentially of, or comprises a nucleotide sequence that differs by 0 or 1 nucleotides from one of the following nucleotide sequences (5'→3'

```
                                    (SEQ ID NO: 621)
UAUUAAGAAAGUAUAAGCCAG;
or

                                    (SEQ ID NO: 748)
TGACAAGAAAGUGCCCAUUUG.
```

Embodiment 27. The RNAi agent of embodiment 26, wherein the sense strand consists of, consists essentially of, or comprises a nucleotide sequence that differs by 0 or 1 nucleotides from one of the following nucleotide sequences (5' 4 3'):

```
(SEQ ID NO: 684)
CUGGCUUAUACUUUCUUAAUA;
or

                                    (SEQ ID NO: 699)
CAAAUGGGCACUUUCUUGUCA.
```

Embodiment 28. The RNAi agent of embodiment 26 or embodiment 27, wherein all or substantially all of the nucleotides are modified nucleotides.

Embodiment 29. The RNAi agent of embodiment 1, comprising an antisense strand that comprises, consists of, or consists essentially of a modified nucleotide sequence that differs by 0 or 1 nucleotides from one of the following nucleotide sequences (5'→3'):

```
                                    (SEQ ID NO: 391)
usAfsuuAfagaaagUfaUfaAfgccassg;
or

                                    (SEQ ID NO: 427)
dTssGfsacaaGfaaagUfgCfcCfauuussg;
```

wherein a represents 2'-O-methyl adenosine, c represents 2'-O-methyl cytidine, g represents 2'-O-methyl guanosine, and u represents 2'-O-methyl uridine; Af, represents 2'-fluoro adenosine, Cf represents 2'-fluoro cytidine, Gf represents 2'-fluoro guanosine, and Uf represents 2'-fluoro uridine; dT represents 2'-deoxythymidine; s represents a phosphorothioate linkage, and ss represents a phosphorodithioate linkage; and wherein all or substantially all of the nucleotides on the sense strand are modified nucleotides.

Embodiment 30. The RNAi agent of embodiment 1, wherein the sense strand comprises, consists of, or consists essentially of a modified nucleotide sequence that differs by 0 or 1 nucleotides from one of the following nucleotide sequences (5'→3'):

```
                                    (SEQ ID NO: 515)
cuggcuuaUfaCfUfuucuuaaua;
or

                                    (SEQ ID NO: 530)
caaaugggCfAfCfuuucuuguca;
```

wherein a represents 2'-O-methyl adenosine, c represents 2'-O-methyl cytidine, g represents 2'-O-methyl guanosine, and u represents 2'-O-methyl uridine; Af, represents 2'-fluoro adenosine, Cf represents 2'-fluoro cytidine, Gf represents 2'-fluoro guanosine, and Uf represents 2'-fluoro uridine; s represents a phosphorothioate linkage and ss represents a phosphorodithioate linkage; and wherein all or substantially all of the nucleotides on the sense strand are modified nucleotides.

Embodiment 31. The RNAi agent of any one of embodiments 26-30, wherein the sense strand further includes inverted abasic residues at the 3' terminal end of the nucleotide sequence, at the 5' end of the nucleotide sequence, or at both.

Embodiment 32. The RNAi agent of any one of embodiments 26-31, wherein the RNAi agent is linked to a targeting ligand.

Embodiment 33. The RNAi agent of any one of embodiments 26-32, wherein the RNAi agent comprises:

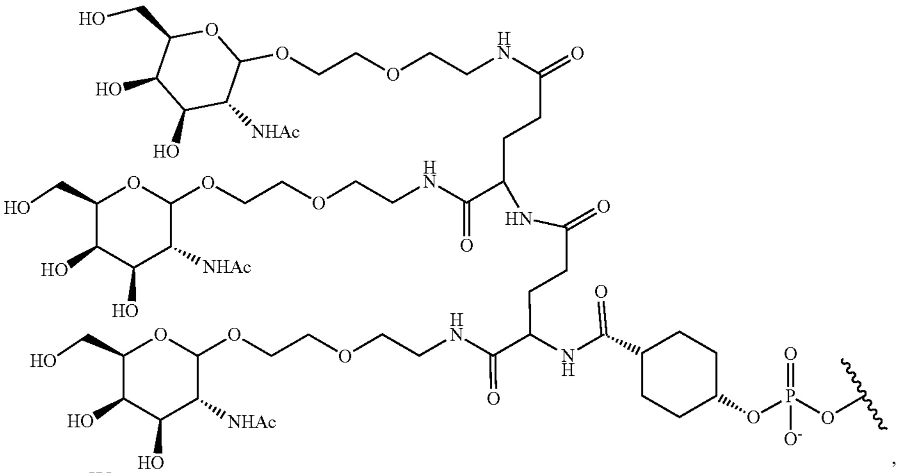

, or

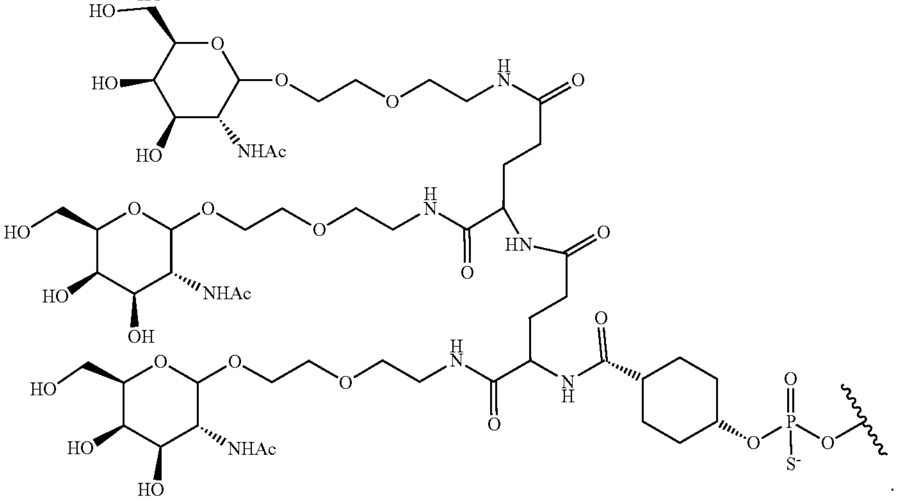

.

Embodiment 34. The RNAi agent of any of embodiments 1-33, wherein the RNAi agent is a pharmaceutically acceptable salt.

Embodiment 35. The RNAi agent of embodiment 34, wherein the RNAi agent is a sodium salt.

Embodiment 36. The RNAi agent of any one of embodiments 1-35, wherein the 5' end of the sense strand is coupled to a targeting ligand comprising the structure of (NAG37)s.

Embodiment 37. A composition comprising the RNAi agent of any one of embodiments 1-36, wherein the composition comprises a pharmaceutically acceptable excipient.

Embodiment 38. The composition of embodiment 37, wherein the pharmaceutically acceptable excipient is water for injection.

Embodiment 39. The composition of embodiment 38, wherein the pharmaceutically acceptable excipient is isotonic saline.

Embodiment 40. A method for inhibiting expression of an Inhibin Subunit Beta E (INHBE) gene in a cell, the method comprising introducing into a cell an effective amount of an RNAi agent of any one of embodiments 1-36 or the composition of any one of embodiments 37-39.

Embodiment 41. The method of embodiment 40, wherein the cell is within a subject.

Embodiment 42. The method of embodiment 41, wherein the subject is ahuman subject.

Embodiment 43. The method of any one of embodiments 40-42, wherein the INHBE gene expression is inhibited by at least about 30%.

Embodiment 44. The method of any one of embodiments 40-43, wherein the INHBE activity is reduced by at least about 50%.

Embodiment 45. A method of treating an INHBE-related disease, disorder, or symptom, the method comprising administering to a human subject in need thereof a therapeutically effective amount of the composition of any one of embodiments 37-39.

Embodiment 46. The method of embodiment 45, wherein the disease is obesity, diabetes, liver inflammation, dyslipidemia, or metabolic disease.

Embodiment 47. The method of any one of embodiments 45-46, wherein the RNAi agent is administered at a dose of about 0.05 mg/kg to about 5.0 mg/kg of body weight of the human subject.

Embodiment 48. The method of any one of embodiments 45-47, wherein the RNAi agent is administered in two or more doses.

Embodiment 49. The method of any one of embodiments 45-48, wherein the body weight of the human subject decreases by at least 5%.

Embodiment 50. The method of any one of embodiments 45-48, wherein the triglycerides, LDL cholesterol, or total cholesterol of the human subject are reduced.

Embodiment 51. The method of any one of embodiments 45-48, wherein the subject's serum Activin E protein levels are reduced.

Embodiment 52. The RNAi agent of any one of embodiments 1-36 or the composition according to any one of embodiments 37-39, for use in the treatment of a disease, disorder, or symptom that is mediated at least in part by a reduction in INHBE gene expression.

Embodiment 53. The RNAi agent of embodiment 52, wherein the disease is obesity, diabetes, liver inflammation, dyslipidemia, or metabolic disease.

Embodiment 54. Use of the RNAi agent of any one of embodiments 1-36 or the composition according to any one of embodiments 37-39, for the preparation of a pharmaceutical composition for treating a disease, disorder, or symptom that is mediated at least in part by a reduction in INHBE gene expression.

Embodiment 55. The use of embodiment 54, wherein the disease is obesity, diabetes, liver inflammation, dyslipidemia, or metabolic disease.

Embodiment 56. The Use according to any one of embodiments 52-55, wherein the RNAi agent is administered at a dose of about 0.05 mg/kg to about 5.0 mg/kg of body weight of the human subject.

Embodiment 57. A method for inhibiting expression of an INHBE gene in a cell, the method comprising introducing into a cell an effective amount of an RNAi agent targeting an INHBE mRNA, wherein the RNAi agent reduces the INHBE activity by at least about 50%.

Embodiment 58. An RNAi agent targeting an INHBE mRNA, wherein the RNAi agent inhibits INHBE protein activity levels in a cell.

Figure 5A:
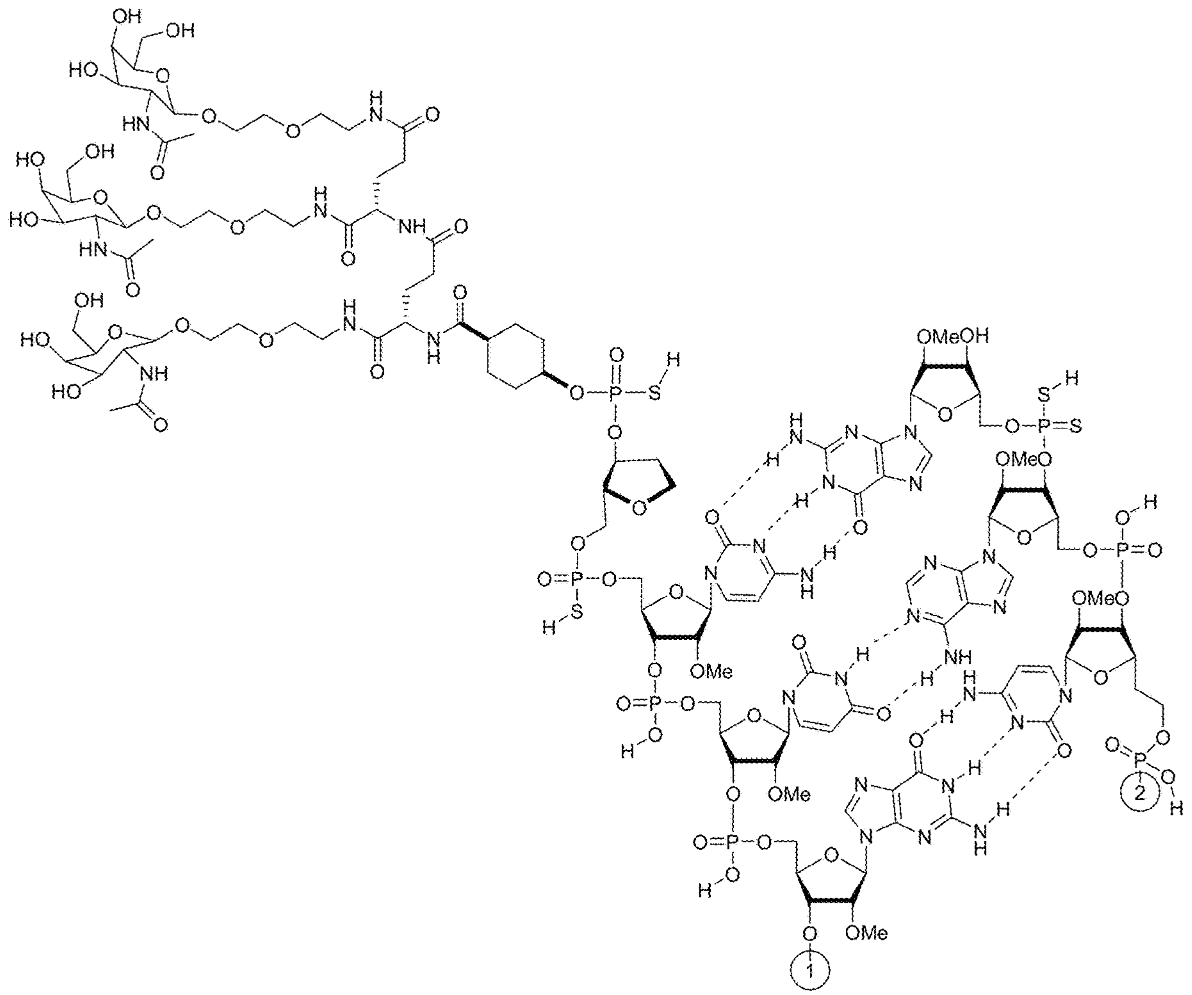
FIG. 5A-5C shows the chemical structure of AC004285, in free acid form (SEQ ID NO: 391 and 515).
Figure 5B:
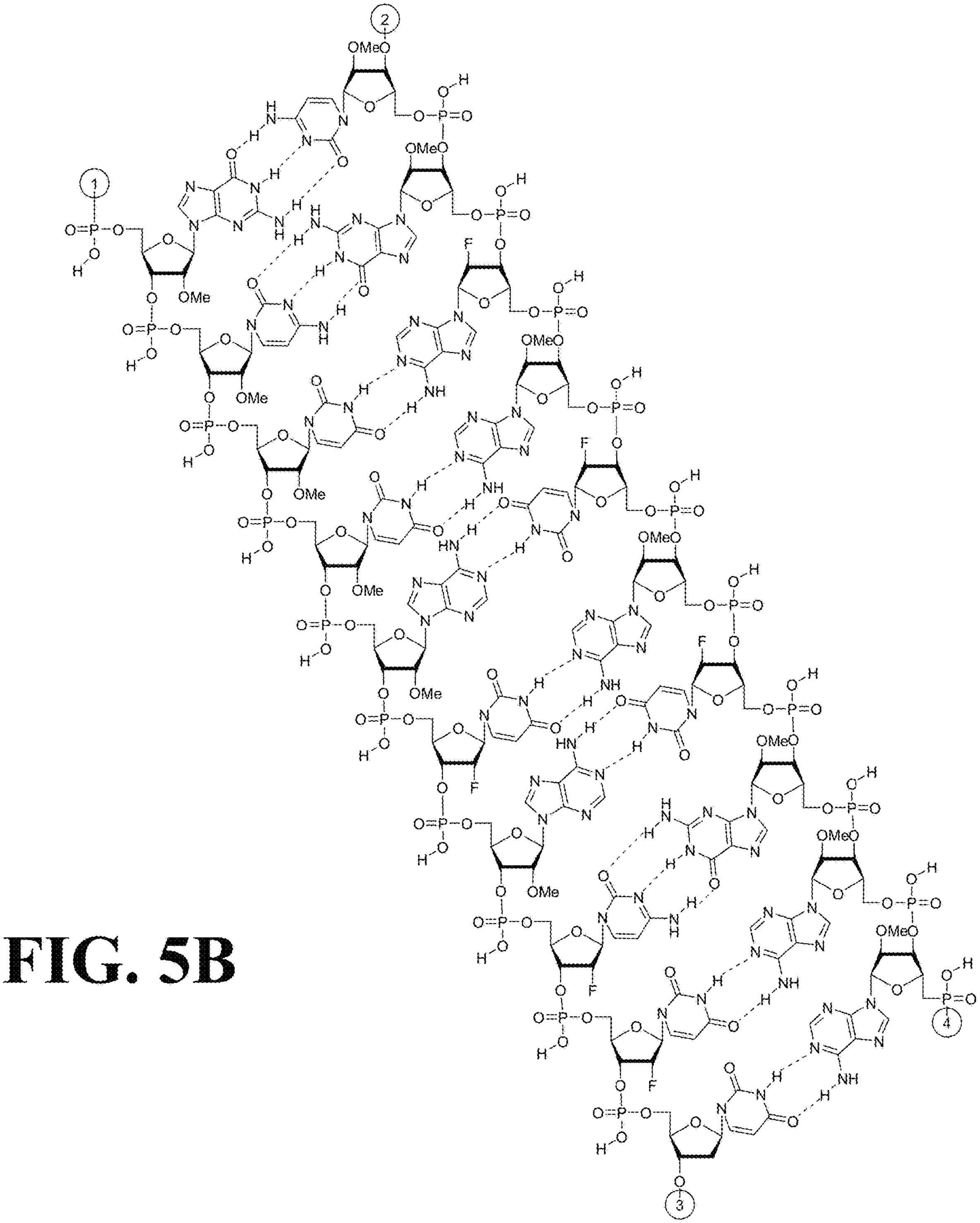
Figure 5C:
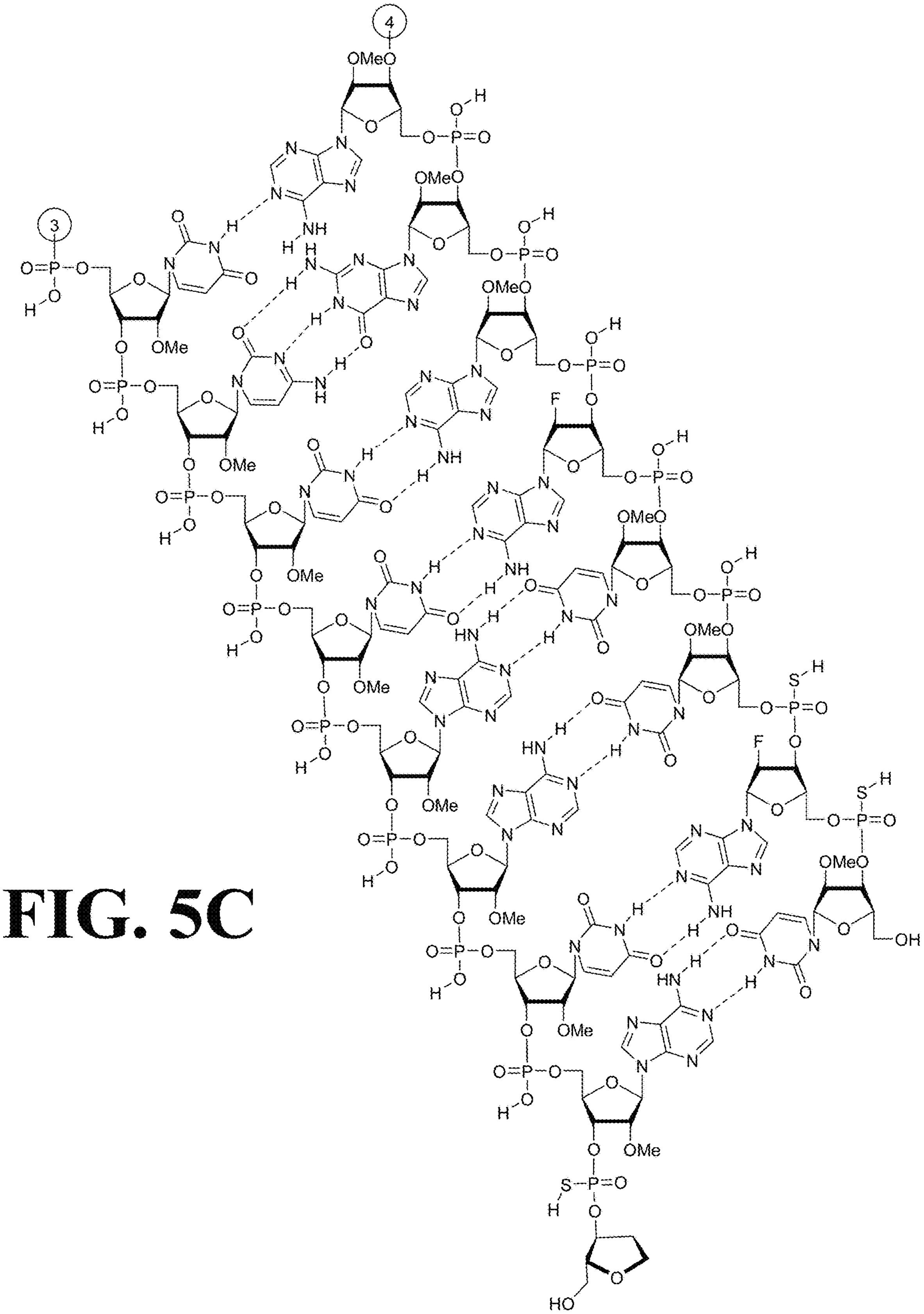

Embodiment 59. A compound of the formula shown in FIGS. 5A-5C, or a pharmaceutically acceptable salt thereof.

Figure 6A:
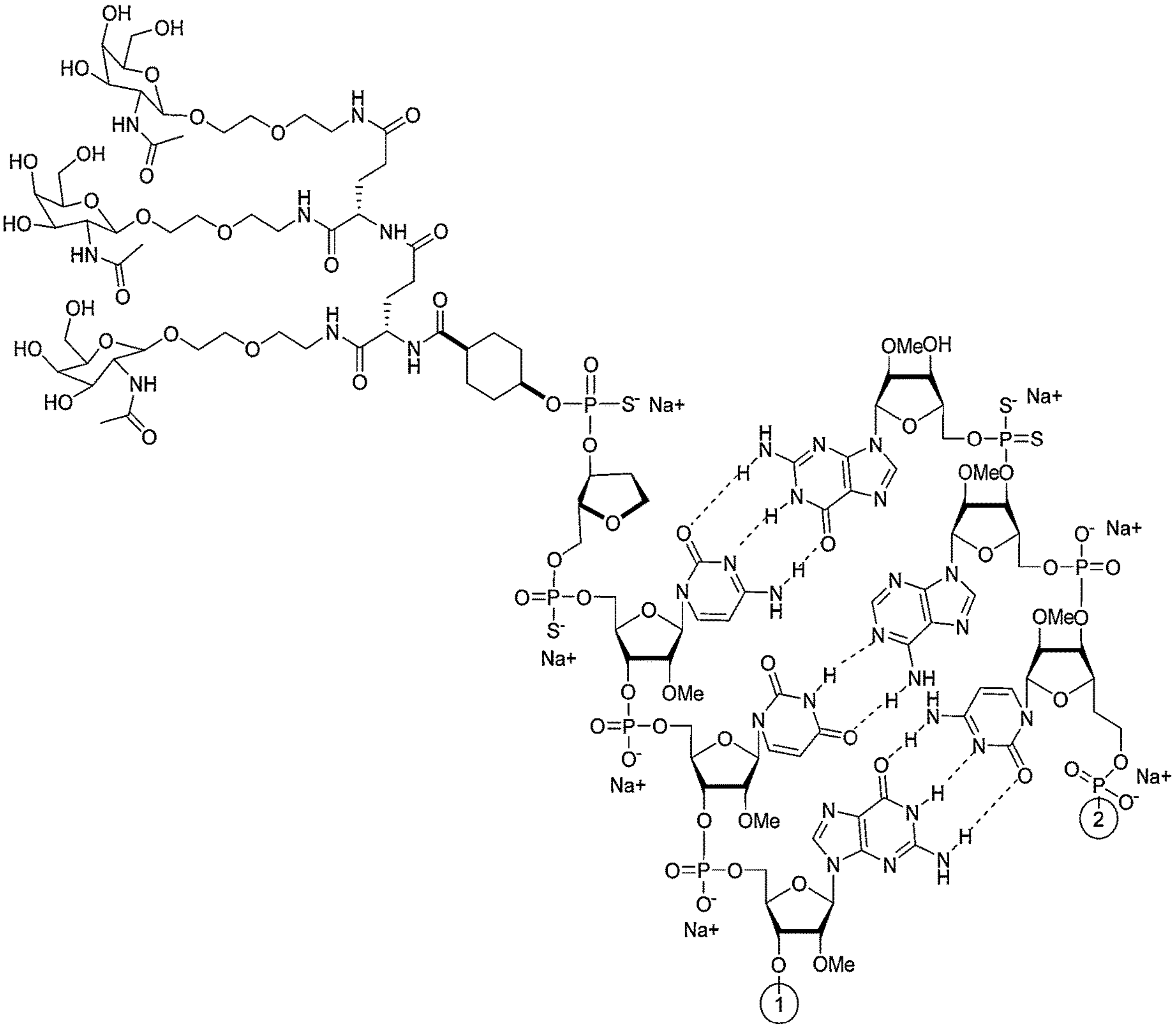
FIG. 6A-6C shows the chemical structure of AC004285, in sodium salt form (SEQ ID NO: 391 and 515).
Figure 6B:
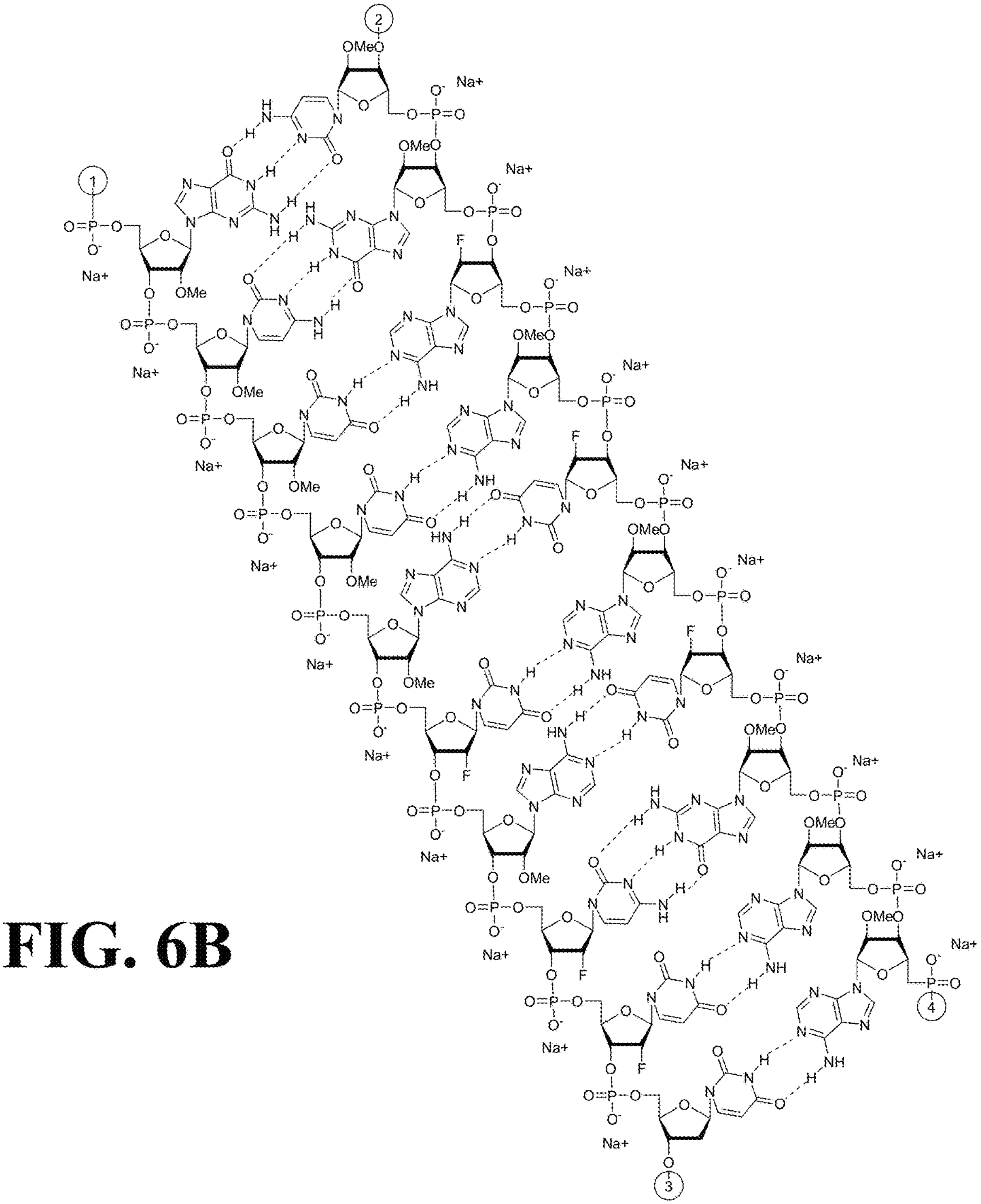
Figure 6C:
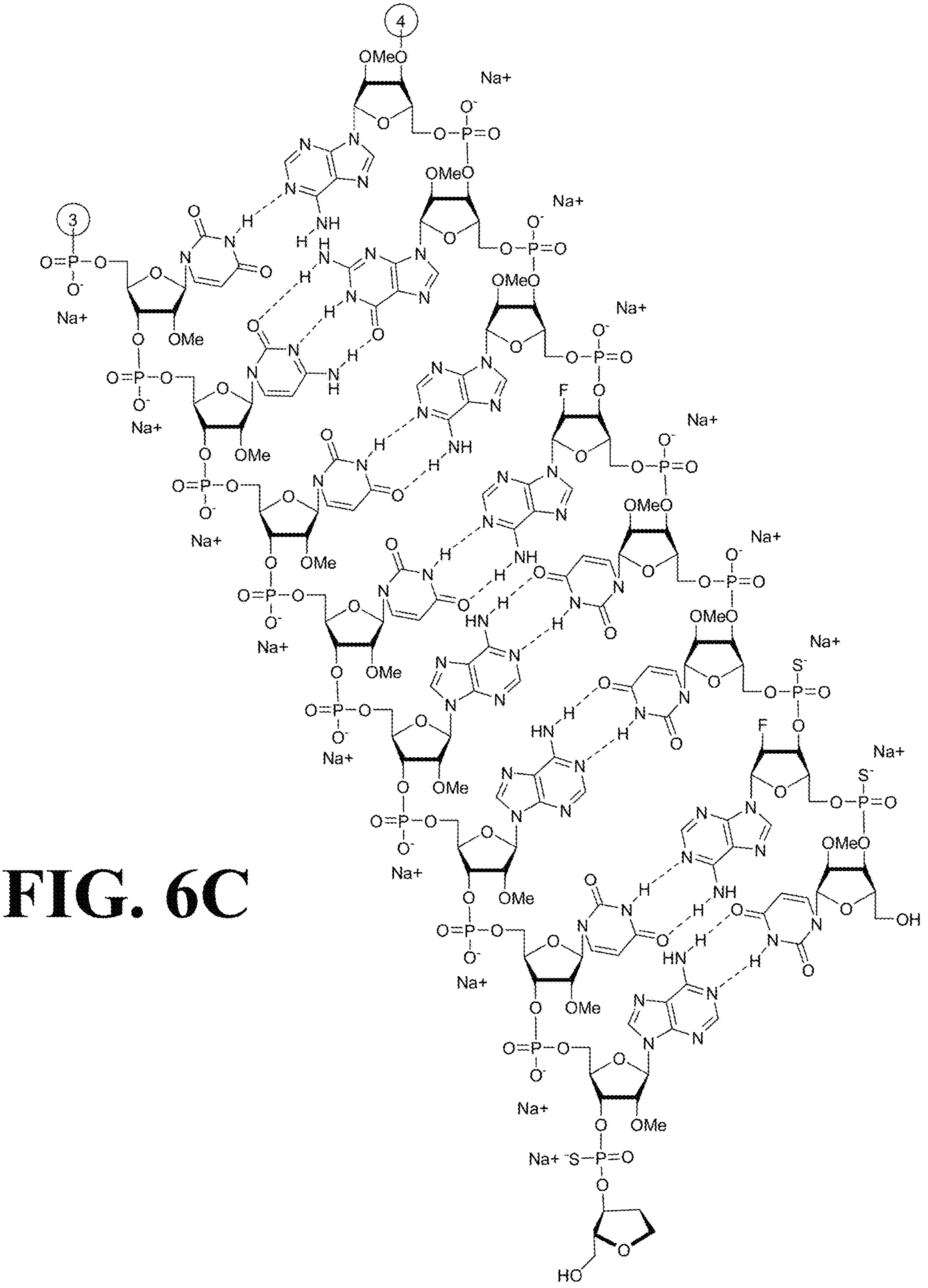

Embodiment 60. A compound of the formula shown in FIGS. 6A-6C.

Figure 7A:
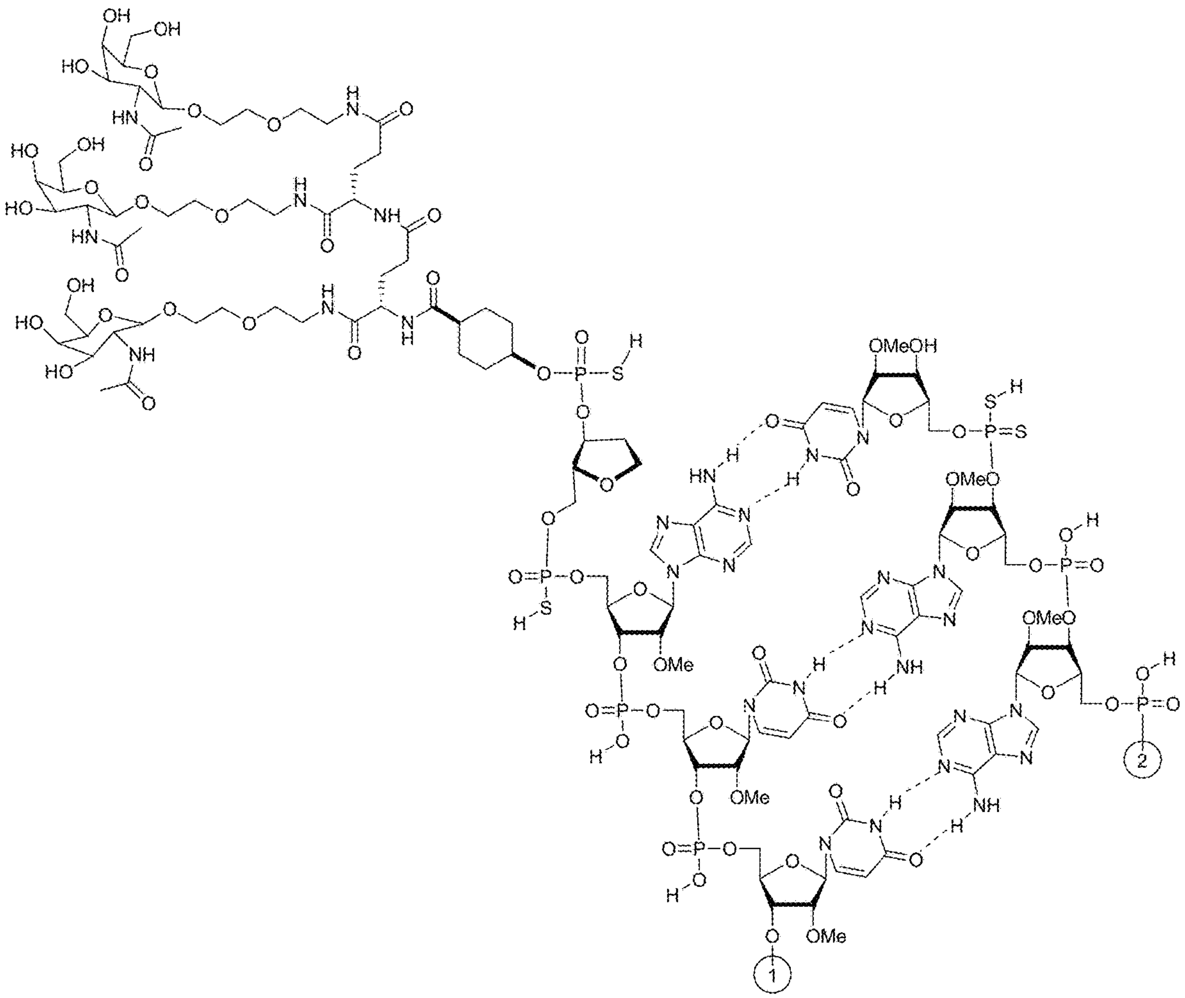
FIG. 7A-7C shows the chemical structure of AC004007, in free acid form (SEQ ID NO: 379 and 510).
Figure 7B:
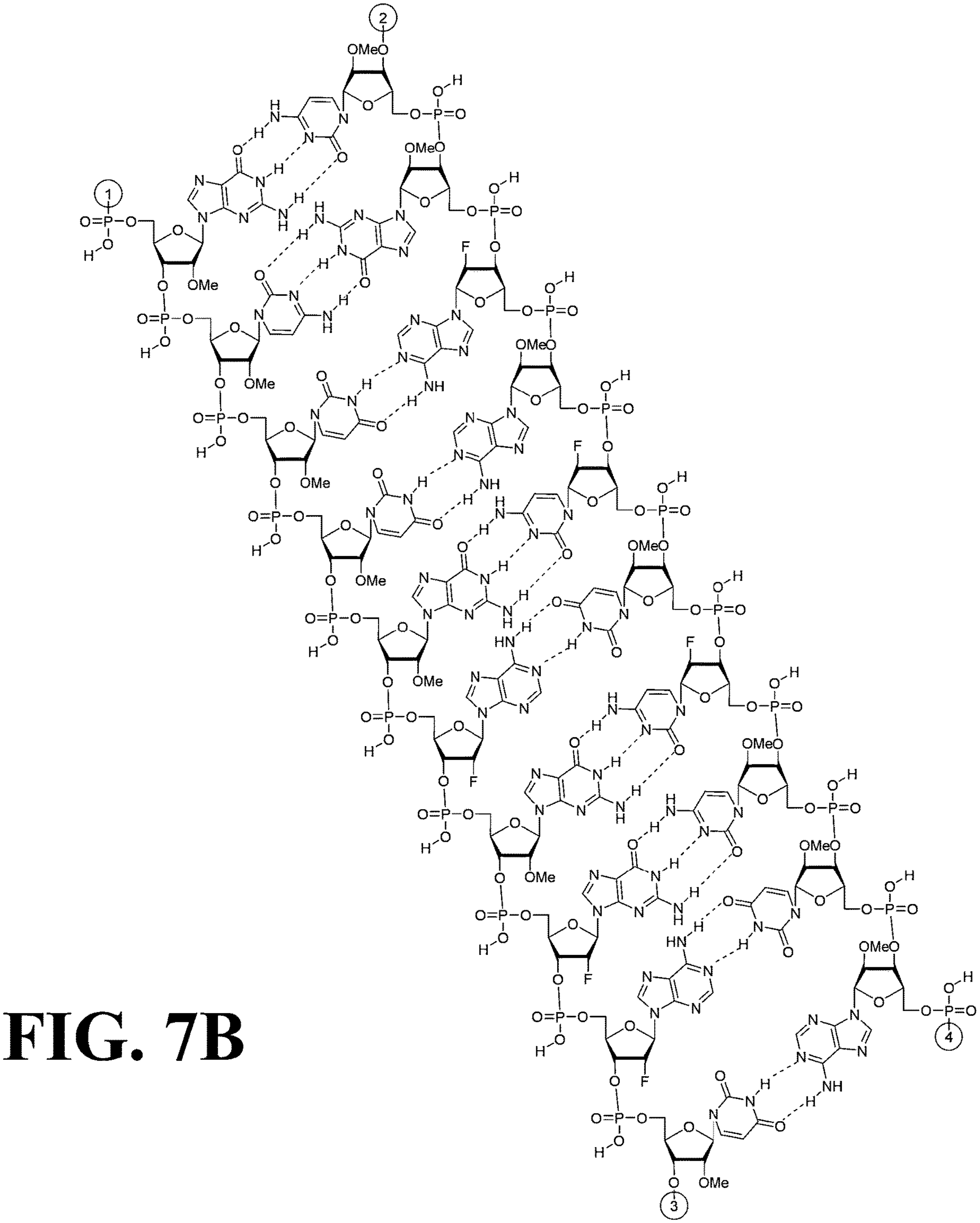
Figure 7C:
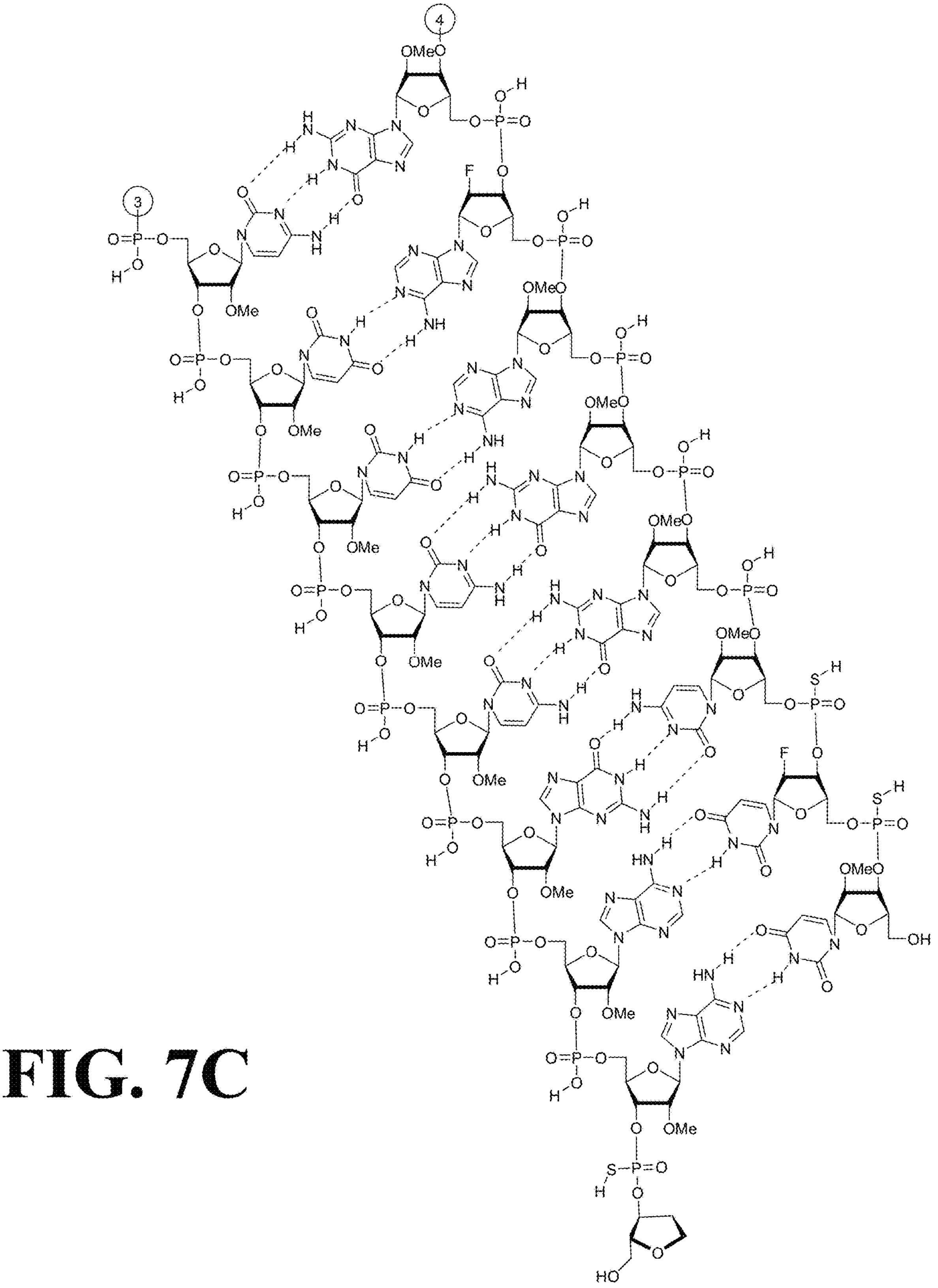

Embodiment 61. A compound of the formula shown in FIGS. 7A-7C, or a pharmaceutically acceptable salt thereof.

Figure 8A:
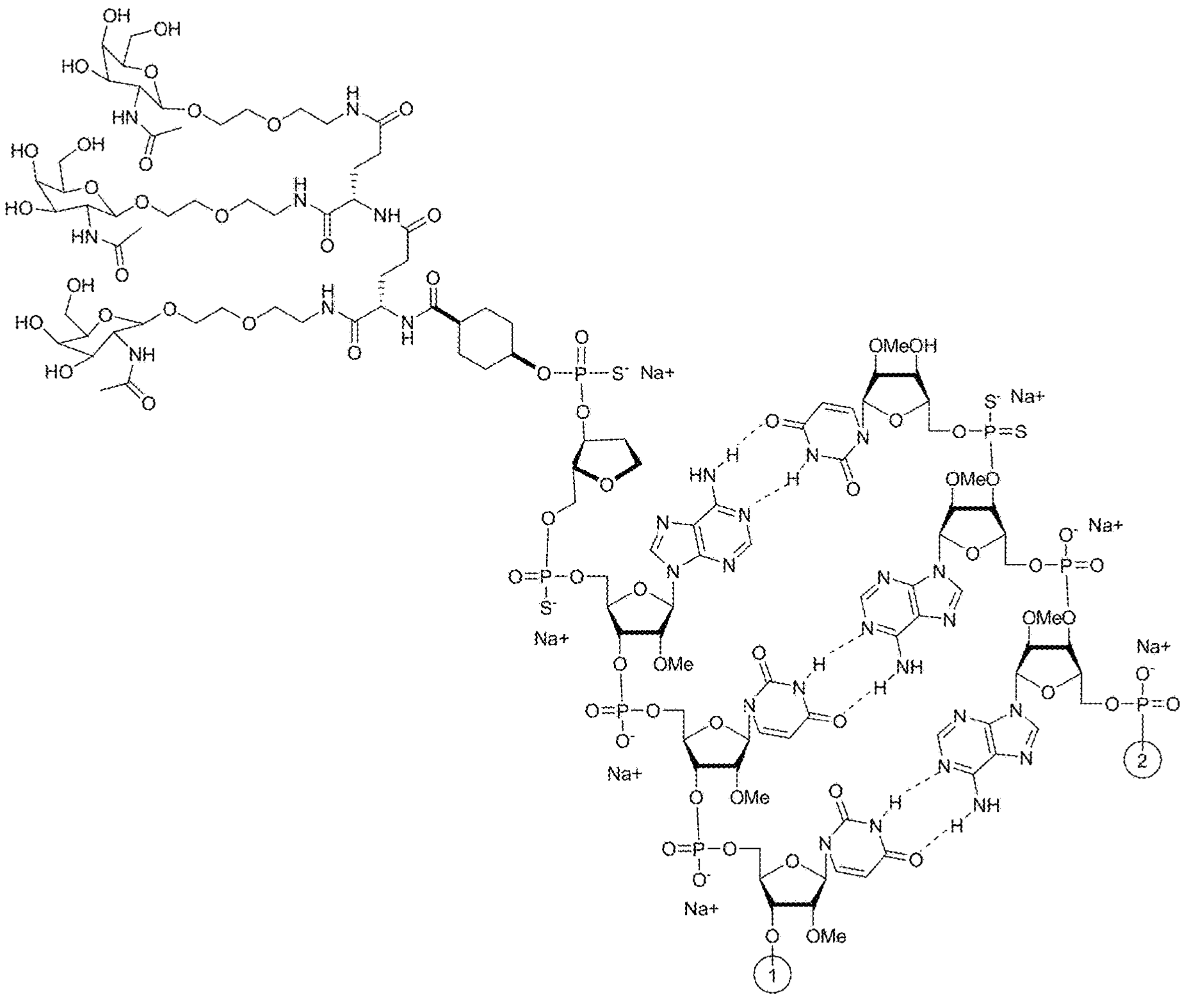
FIG. 8A-8C shows the chemical structure of AC004007, in sodium salt form (SEQ ID NO: 379 and 510).
Figure 8B:
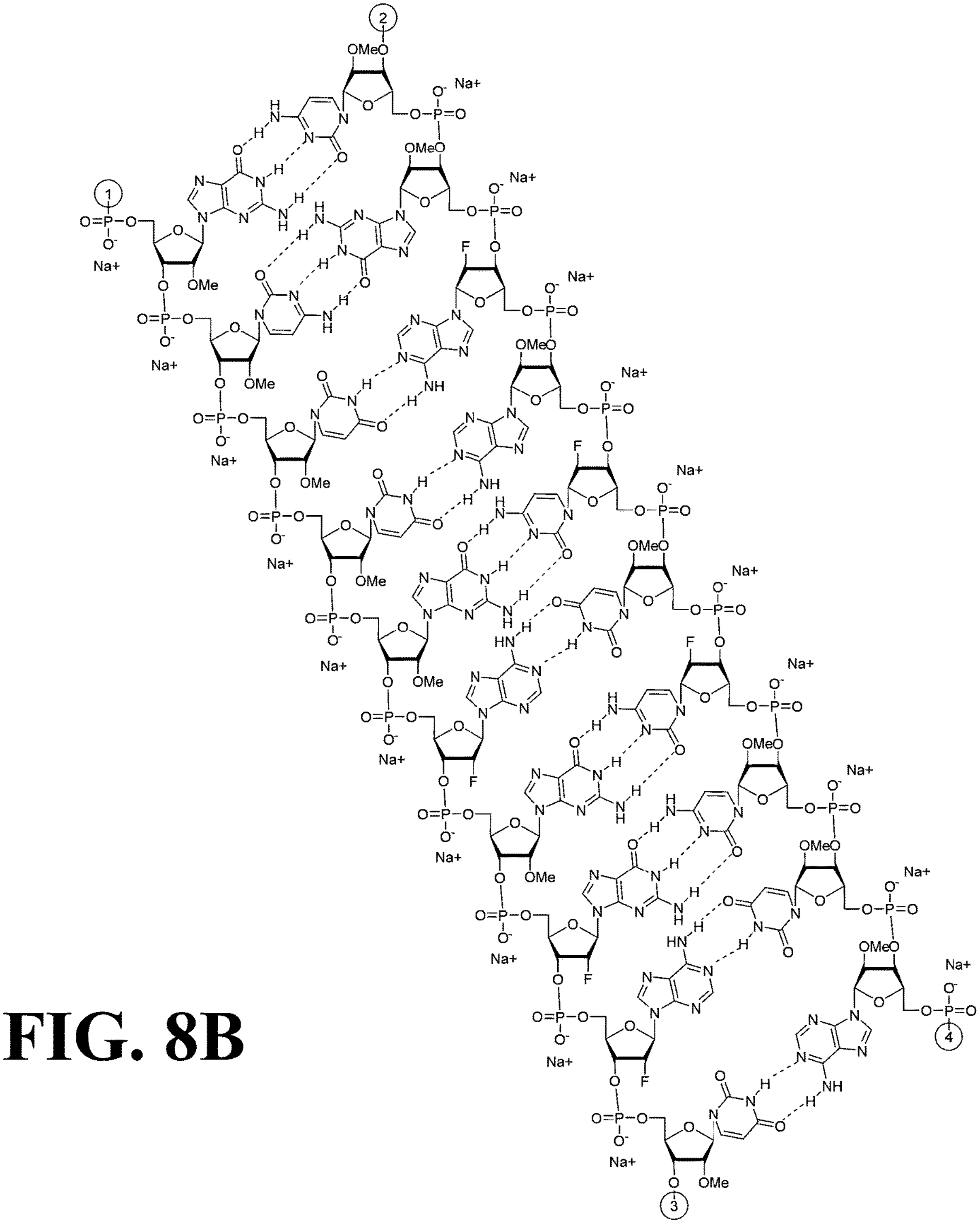
Figure 8C:
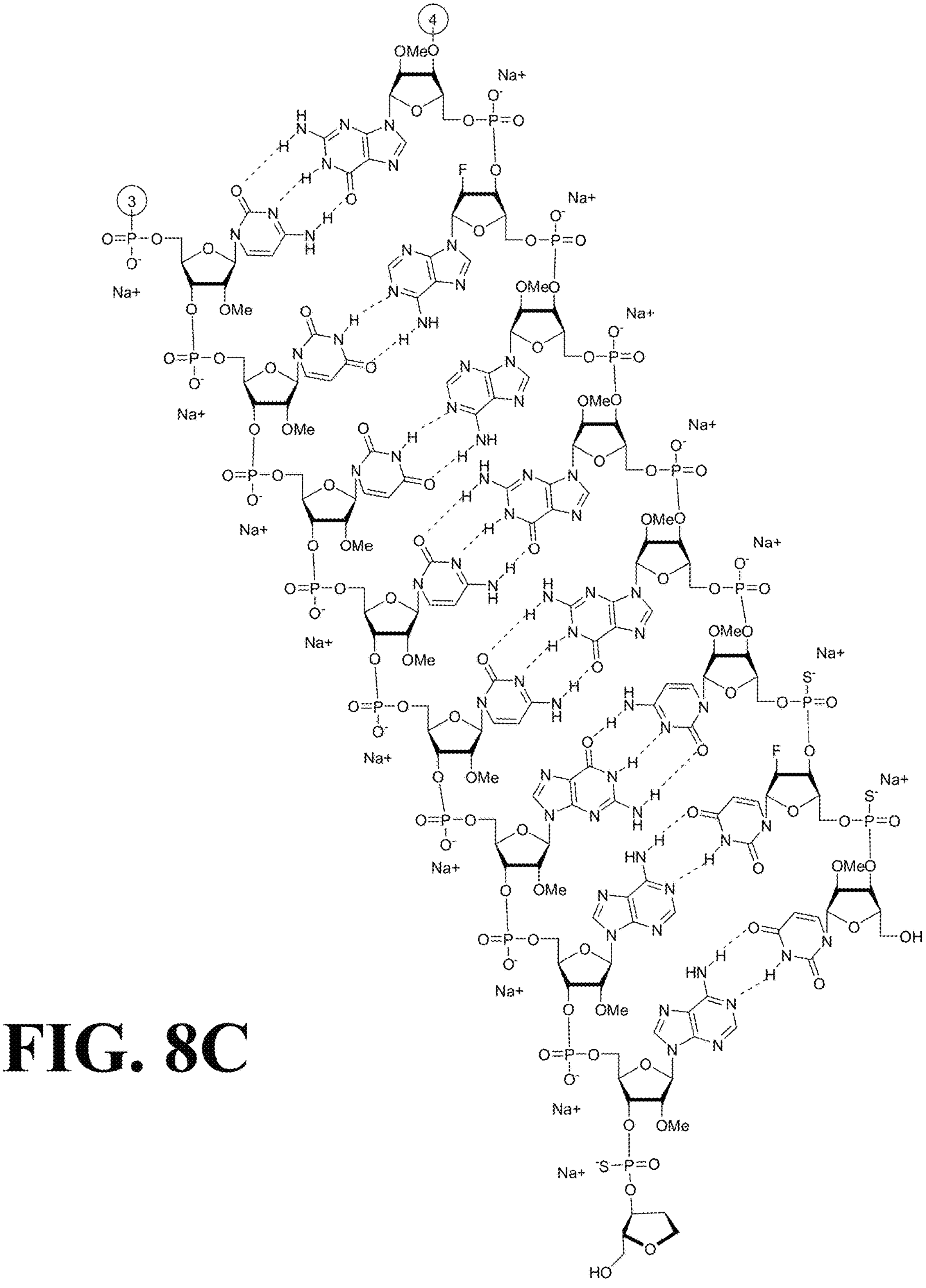

Embodiment 62. A compound of the formula shown in FIGS. 8A-8C.

The above provided embodiments and items are now illustrated with the following, non-limiting examples.

EXAMPLES

Example 1. Synthesis of INHBE RNAi Agents

INHBE RNAi agent duplexes shown in Tables 5A, 5B, and 5C, above, were synthesized in accordance with the following general procedures:

A. Synthesis.

The sense and antisense strands of the RNAi agents were synthesized according to phosphoramidite technology on solid phase used in oligonucleotide synthesis. Such standard synthesis is generally known in the art. Depending on the scale, either a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, PA, USA). The monomer positioned at the 3' end of the respective strand was attached to the solid support as a starting point for synthesis. All RNA and 2'-modified RNA phosphoramidites were purchased from Thermo Fisher Scientific (Milwaukee, WI, USA) or Hongene Biotech (Shanghai, PRC). The 2'-O-methyl phosphoramidites included the following: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl amidites. 5'-(4,4'-Dimethoxytrityl)-2',3'-seco-uridine, 2'-benzoyl-3'-[(2-cyanoethyl)-(N,N-diisopropyl)]-phosphoramidite was also purchased from Thermo Fisher Scientific or Hongene Biotech. 5'-dimethoxytrityl-2'-O-methyl-inosine-3'-O-(2-cyanoethyl-N,N-diisopropylamino) phosphoramidites were purchased from Glen Research (Virginia) or Hongene Biotech. The cyclopropyl phosphonate phosphoramidites were synthesized in accordance with International Patent Application Publication No. WO 2017/214112 (see also Altenhofer et. al., Chem. Communications (Royal Soc. Chem.), 57(55): 6808-6811 (July 2021)). The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA) or SAFC (St Louis, MO, USA). 5'-O-dimethoxytrityl-$N^2$,$N^6$-(phenoxyacetate)-2'-O-methyl-diaminopurine-3'-O-(2-cyanoethyl-N,N-diisopropylamino) phosphoramidites were obtained from ChemGenes or Hongene Biotech.

Targeting ligand-containing phosphoramidites were dissolved in anhydrous dichloromethane or anhydrous acetonitrile (50 mM), while all other amidites were dissolved in anhydrous acetonitrile (50 mM), or anhydrous dimethylformamide and molecular sieves (3 Å) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 12 min (RNA), 15 min (targeting ligand), 90 sec (2'-OMe), and 60 sec (2'-F). In order to introduce phosphorothioate linkages, a 100 mM solution of 3-phenyl 1,2,4-dithiazoline-5-one (POS, obtained from PolyOrg, Inc., Leominster, MA, USA) in anhydrous Acetonitrile was employed. Unless specifically identified as a "naked" RNAi agent having no targeting ligand present, each of the INHBE RNAi agent duplexes synthesized and tested in the following Examples utilized N-acetyl-galactosamine (NAG) in the targeting ligand chemical structures represented in Table 6, but that could be substituted with other galactose derivatives to the extent understood by a person of ordinary skill in the art to be attached in view of the structures and description provided herein.

(NAG37) and (NAG37)s targeting ligand phosphoramidite compounds can be synthesized in accordance with International Patent Application Publication No. WO 2018/044350 to Arrowhead Pharmaceuticals, Inc. and other similar, comparable processes. A flow chart depicting a suitable process for synthesizing NAG37 Amidite (a targeting ligand-containing phosphoramidite compound) is shown in the following Scheme 1 and Scheme 2.

Scheme 1. Synthesis of 5

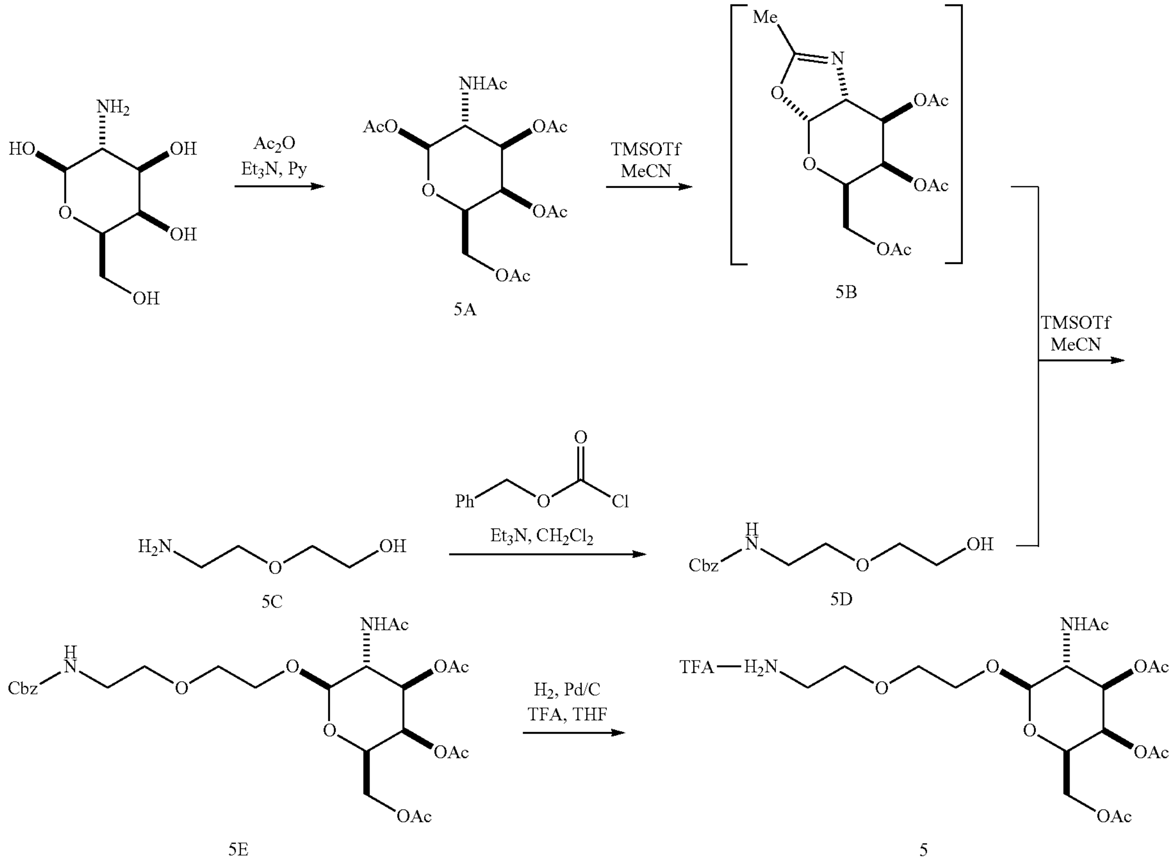

The trifluoroacetate (TFA) salt 5 is synthesized as shown in Scheme 1. D-Galactosamine is peracetylated using acetic anhydride and catalytic N,N-dimethylaminopyridine in pyridine to form acetate 5A. Treatment of 5A with trimethylsilyl trifluoromethylsulfonate allows for the formation of the fused ring system of 5B through anchimeric displacement of the alpha acetate with the adjacent acetamide group, forming the oxazoline 5B as an unisolated intermediate. Amino alcohol 5C is treated with benzyl chloroformate to protect the amine and form primary alcohol 5D. The addition of 5D to the solution of 5B opens the oxazoline and reforms the acetamide functional group. The resulting intermediate, 5E, is isolated by precipitation from methyl tert-butyl ether and the solids are further purified by reslurrying in ethyl acetate and n-heptane. Hydrogenolysis of the Cbz group with palladium on carbon with trifluoroacetic acid in tetrahydrofuran produces 5 as a TFA salt in a THF solution and it is used as this solution without further purification.

N-Cbz-L-glutamic Acid 5-tert-Butyl Ester, 1 is activated with iso-valeryl chloride to form the mixed anhydride. The addition of bis-tert-butyl ester-protected glutamic acid, 2 gave amide, 3, which is isolated as an ethyl acetate solution and used without further purification. Deprotection all tert-butyl esters with formic acid gave triacid 4. After a solvent exchange, the crude solid of 4 is isolated from n-hexane and dissolved in methyl tert-butyl ether for additional water washes before concentration of the solution for use in the next step. TFA salt 5 is coupled to each of the three free carboxylic acids to form triantennary acetyl galactosamine compound, 6. Crude 6 is isolated by precipitation with methyl tert-butyl ether and precipitated three times using methanol and methyl tert-butyl ether. Hydrogenolysis of the Cbz group of 6 results in the primary amine 7 which is isolated as a TFA salt by precipitation using methyl tert-butyl ether. The TFA salt is used without further purification and is coupled with cis-4-hydroxy-cyclohexanecarboxylic acid (7A) to provide the secondary alcohol 8. After isolation of the crude solid, 8 is dissolved in acetonitrile and methyl tert-butyl ether and then precipitated with n-heptane three times to purify 8. Phosphitylation of the secondary alcohol with 2-cyanoethyl N,N,N',N'-tetraisopropylphosphorodiamidite produces the NAG37 amidite. The NAG37 amidite is purified by resuspending in a mixture of acetonitrile, methyl tert-butyl ether, and n-heptane to meet the specifications for both HPLC purity and 31P-NMR purity.

Scheme 2. Synthesis of NAG37 Amidite
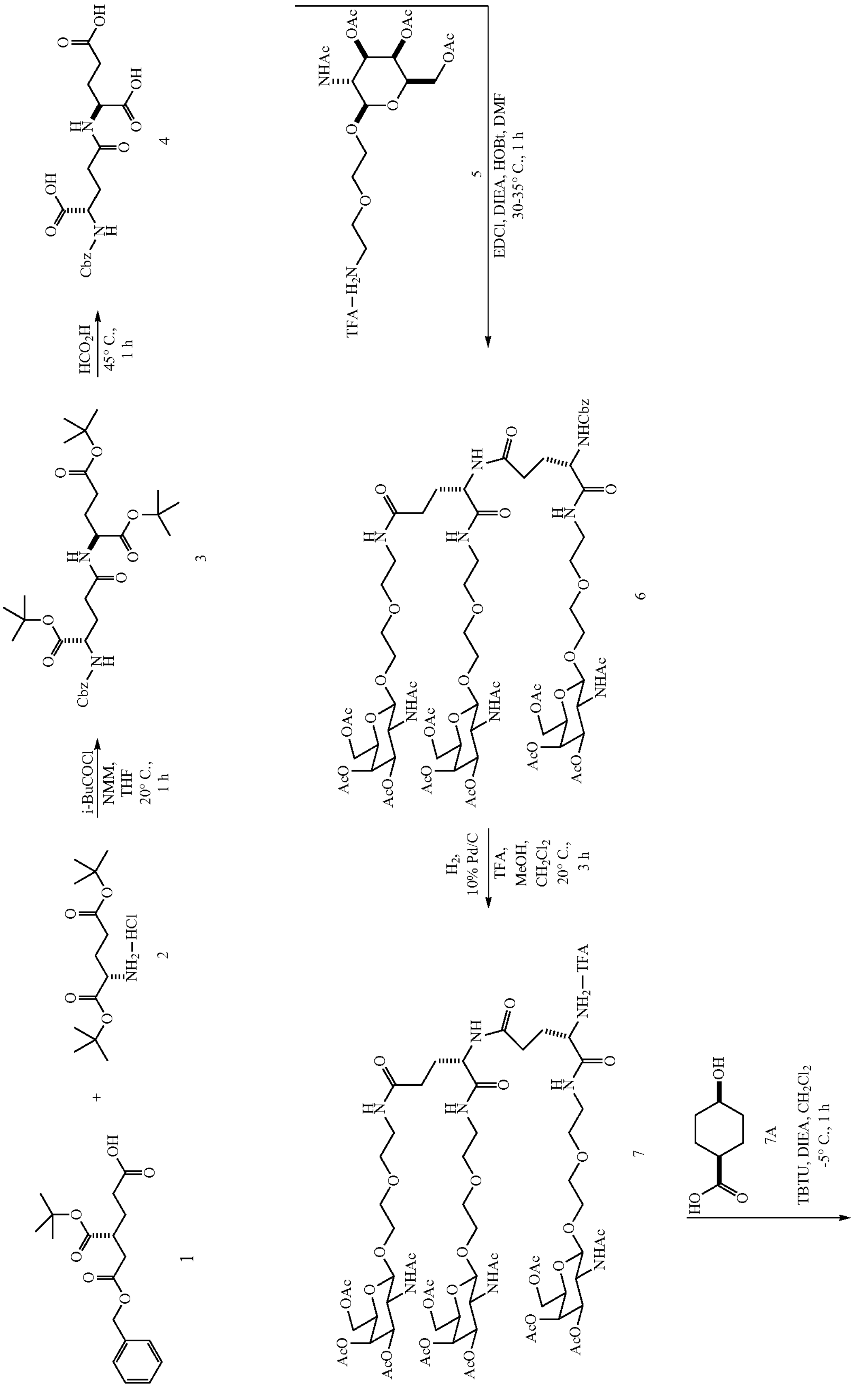
1 + 2
3
4
5
6
7
7A

-continued
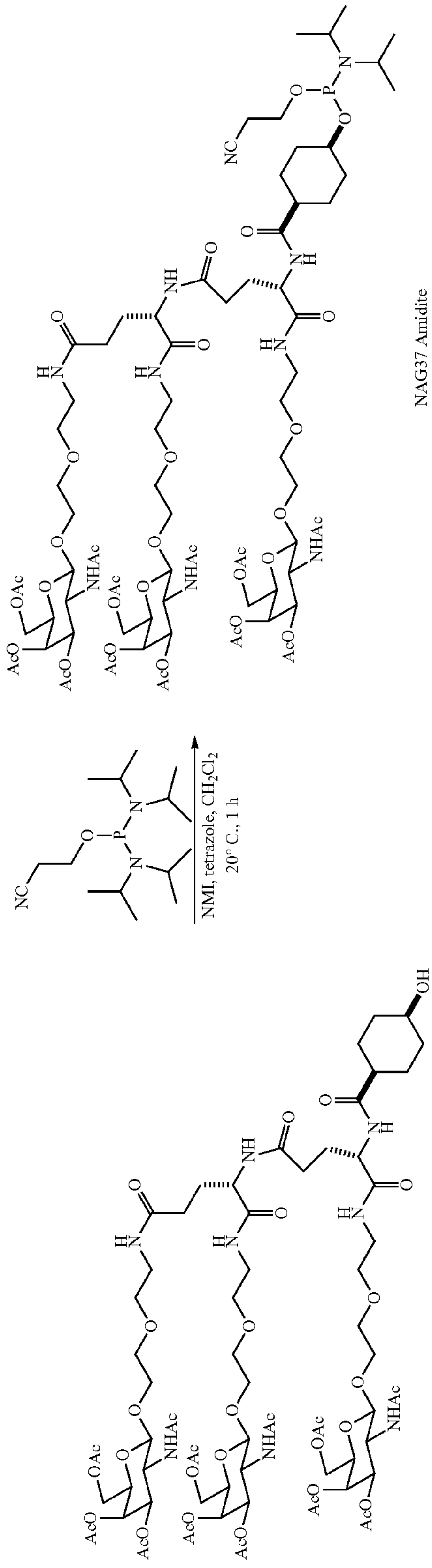
8
NAG37 Amidite

B. Cleavage and Deprotection of Support Bound Oligoner.

After finalization of the solid phase synthesis, the dried solid support was treated with a 1:1 volume solution of 40 wt. % methylamine in water and 28% ammonium hydroxide solution (Aldrich) for 1.5 hours at 30° C. The solution was evaporated and the solid residue was reconstituted in water (see below).

C. Purification.

Crude oligomers were purified by anionic exchange HPLC using a TSKgel SuperQ-5PW 13 μm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 26/40 column packed with Sephadex G-25 fine with a running buffer of filtered DI water or 100 mM ammonium bicarbonate, pH 6.7 and 20% Acetonitrile.

D. Annealing.

Complementary strands were mixed by combining equimolar RNA solutions (sense and antisense) in 1× Phosphate-Buffered Saline (Corning, Cellgro) to form the RNAi agents. Some RNAi agents were lyophilized and stored at −15 to −25° C. Duplex concentration was determined by measuring the solution absorbance on a UV-Vis spectrometer in 1× Phosphate-Buffered Saline. The solution absorbance at 260 nm was then multiplied by a conversion factor and the dilution factor to determine the duplex concentration. The conversion factor used was either 0.050 mg/(mL-cm) or was calculated from an experimentally determined extinction coefficient.

Example 2. INHBE-GLuc AAV Mouse Model

To evaluate certain INHBE RNAi agents in vivo, an INHBE-GLuc (Gaussia Luciferase) AAV (Adeno-associated virus) mouse model was used. Six- to eight-week-old male C57BL/6 mice were transduced with INHBE-GLuc AAV serotype 8 (INHBE-Gluc AAV8), administered at least 14 days prior to administration of an INHBE RNAi agent or control. The genome of the INHBE-GLuc AAV contains the 231-2413 region of the human INHBE cDNA sequence (GenBank NM_031479.5) inserted into the 3' UTR of the GLuc reporter gene sequence. 5E12 to 1E13 GC/kg (genome copies per kg animal body weight) of the respective virus in PBS in a total volume of 10 mL/kg animal's body weight was injected into mice via the tail vein to create INHBE-GLuc AAV model mice. Inhibition of INHBE expression by an INHBE RNAi agent results in concomitant inhibition of GLuc expression, which is measured. Prior to administration of a treatment (between day −7 and day 1 pre-dose), GLuc expression levels in serum were measured by the Pierce™ Gaussia Luciferase Glow Assay Kit (Thermo Fisher Scientific), and the mice were grouped according to average GLuc levels.

Mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C. Serum was collected and measured by the Pierce™ *Gaussia* Luciferase Glow Assay Kit according to the manufacturer's instructions. Serum GLuc levels for each animal can be normalized to the control group of mice injected with vehicle control in order to account for the non-treatment related shift in INHBE expression with this model. To do so, first, the GLuc level for each animal at a time point was divided by the pre-treatment level of expression in that animal (Day 1) in order to determine the ratio of expression "normalized to pre-treatment". Expression at a specific time point was then normalized to the control group by dividing the "normalized to pre-treatment" ratio for an individual animal by the average "normalized to pre-treatment" ratio of all mice in the normal vehicle control group. Alternatively, the serum GLuc levels for each animal was assessed by normalizing to pre-treatment levels only.

Example 3. In Vivo Testing of INHBE RNAi Agents in Mice

At Day 1, four (n=4) female C57bl/6 mice in each group were dosed with either saline or INHBE RNAi agents formulated in saline (at 3.0 mg/kg), via subcutaneous (SQ) injection, at 200 μL per 20 g body weight injection volume. The dosing regimen was in accordance with Table 7 below.

TABLE 7

Dosing Groups of Example 3.

| Group ID | RNAi Agent | Dose | Dosing Regimen | # Animals | Targeted Position of INHBE Seq ID No. 1 |
|---|---|---|---|---|---|
| 1 | Saline | N/A | Single subcutaneous injection on day 1 | n = 4 | N/A |
| 2 | AC911861 | 3.0 mg/kg | Single subcutaneous injection on day 1 | n = 4 | 1039 |
| 3 | AC911864 | 3.0 mg/kg | Single subcutaneous injection on day 1 | n = 4 | 1217 |
| 4 | AC911865 | 3.0 mg/kg | Single subcutaneous injection on day 1 | n = 4 | 1219 |

The injections were performed between the skin and muscle (i.e. subcutaneous injections) into the loose skin over the neck and shoulder area. Animals were weighed prior to dosing, and the dosing volume was individually adjusted based on the animal body weight. On Day 15 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

INHBE mRNA levels were quantified via qPCR, with mActinB as endogenous control. The results are shown in Table 8 below.

TABLE 8

Average INHBE Normalized to Control in Mice from Example 3.

| Group ID | Day 15 Avg INHBE | Low | High |
|---|---|---|---|
| Group 1 Saline | 1.000 | 0.434 | 0.768 |
| Group 2 3.0 mg/kg AC911861 | 0.230 | 0.049 | 0.063 |
| Group 3 3.0 mg/kg AC911864 | 0.320 | 0.128 | 0.213 |
| Group 4 3.0 mg/kg AC911865 | 0.429 | 0.145 | 0.220 |

The INHBE RNAi agents of Groups 2-4 are cross reactive across both mouse and human INHBE. The INHBE RNAi agents showed inhibition of INHBE out to at least Day 15 with single 3.0 mg/kg dose, up to ~77% inhibition by AC911861 on Day 15.

Example 4. In Vivo Testing of INHBE RNAi Agents in Mice

The INHBE-GLuc-AAV model as described in Example 2, above, was used. On Day −14, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 9.0 mg/kg), via subcutaneous (SQ) injection, at 250 μL per 25 g body weight injection volume. The dosing regimen was in accordance with Table 9 below.

TABLE 9

Dosing Groups of Example 4.

| Group ID | RNAi Agent | Dose | Dosing Regimen | Targeted Position of INHBE Seq ID No. 1 |
|---|---|---|---|---|
| 1 | Saline | N/A | Single SQ injection on day 1 | N/A |
| 2 | AC911861 | 9.0 mg/kg | Single SQ injection on day 1 | 1039 |
| 3 | AC911864 | 9.0 mg/kg | Single SQ injection on day 1 | 1217 |
| 4 | AC911855 | 9.0 mg/kg | Single SQ injection on day 1 | 634 |
| 5 | AC911856 | 9.0 mg/kg | Single SQ injection on day 1 | 643 |
| 6 | AC911857 | 9.0 mg/kg | Single SQ injection on day 1 | 782 |
| 7 | AC911858 | 9.0 mg/kg | Single SQ injection on day 1 | 783 |
| 8 | AC911859 | 9.0 mg/kg | Single SQ injection on day 1 | 880 |
| 9 | AC911860 | 9.0 mg/kg | Single SQ injection on day 1 | 1037 |
| 10 | AC911862 | 9.0 mg/kg | Single SQ injection on day 1 | 1099 |
| 11 | AC911863 | 9.0 mg/kg | Single SQ injection on day 1 | 1202 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 10, with average GLuc reflecting the normalized average value of GLuc. Inhibition of INHBE expression by an INHBE RNAi agent results in concomitant inhibition of GLuc expression, which is measured.

TABLE 10

Average GLuc normalized to pre-treatment and saline control in INHBE-AAV-GLuc mice of Example 4.

| Group ID | Day 8 Avg GLuc | Day 8 Std Dev | Day 15 Avg GLuc | Day 15 Std Dev | Day 22 Avg GLuc | Day 22 Std Dev |
|---|---|---|---|---|---|---|
| 1. Saline | 1.000 | 0.206 | 1.000 | 0.119 | 1.000 | 0.278 |
| 2. 9.0 mg/kg AC911861 | 0.677 | 0.172 | 0.684 | 0.184 | 0.766 | 0.195 |
| 3. 9.0 mg/kg AC911864 | 0.117 | 0.009 | 0.110 | 0.010 | 0.120 | 0.010 |
| 4. 9.0 mg/kg AC911855 | 0.595 | 0.124 | 0.530 | 0.032 | 0.716 | 0.093 |
| 5. 9.0 mg/kg AC911856 | 0.088 | 0.025 | 0.118 | 0.037 | 0.190 | 0.053 |

TABLE 10-continued

| Average GLuc normalized to pre-treatment and saline control in INHBE-AAV-GLuc mice of Example 4. | | | | | | |
|---|---|---|---|---|---|---|
| | Day 8 | | Day 15 | | Day 22 | |
| Group ID | Avg GLuc | Std Dev | Avg GLuc | Std Dev | Avg GLuc | Std Dev |
| 6. 9.0 mg/kg AC911857 | 0.447 | 0.113 | 0.439 | 0.076 | 0.650 | 0.129 |
| 7. 9.0 mg/kg AC911858 | 0.621 | 0.047 | 0.650 | 0.082 | 0.954 | 0.224 |
| 8. 9.0 mg/kg AC911859 | 0.225 | 0.067 | 0.214 | 0.046 | 0.236 | 0.055 |
| 9. 9.0 mg/kg AC911860 | 0.502 | 0.041 | 0.470 | 0.069 | 0.546 | 0.017 |
| 10. 9.0 mg/kg AC911862 | 0.313 | 0.042 | 0.360 | 0.121 | 0.563 | 0.111 |
| 11. 9.0 mg/kg AC911863 | 0.148 | 0.028 | N/A | N/A | 0.168 | 0.021 |

Groups 2-11 showed reduction in AAV-INHBE at Day 8 and Day 22 compared to the saline control Group 1. Groups 2-10 showed reduction in AAV-INHBE at Day 15 compared to the saline control Group 1. More specifically, AC911856 achieved ~91% inhibition on Day 8. The INHBE RNAi agents achieved reduction of AAV-INHBE out to at least Day 22. Notably, Group 3 (9.0 mg/kg AC911864) achieved ~88% inhibition (0.120) at Day 22.

Example 5. In Vivo Testing of INHBE RNAi Agents in Mice

The INHBE-GLuc-AAV model as described in Example 2, above, was used. On Day −14, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 9 mg/kg), via subcutaneous (SQ) injection, at 200 μL per 20 g body weight injection volume. The dosing regimen was in accordance with Table 11 below.

TABLE 11

| Dosing Groups of Example 5. | | | | |
|---|---|---|---|---|
| Group ID | RNAi Agent | Dose | Dosing Regimen | Targeted Position of INHBE Seq ID No. 1 |
| 1 | Saline | N/A | Single SQ injection on day 1 | N/A |
| 2 | AC911861 | 9.0 mg/kg | Single SQ injection on day 1 | 1039 |
| 3 | AC911864 | 9.0 mg/kg | Single SQ injection on day 1 | 1217 |
| 4 | AC911866 | 9.0 mg/kg | Single SQ injection on day 1 | 1348 |
| 5 | AC911867 | 9.0 mg/kg | Single SQ injection on day 1 | 1390 |
| 6 | AC911868 | 9.0 mg/kg | Single SQ injection on day 1 | 1405 |
| 7 | AC911869 | 9.0 mg/kg | Single SQ injection on day 1 | 1428 |
| 8 | AC911870 | 9.0 mg/kg | Single SQ injection on day 1 | 1466 |
| 9 | AC911871 | 9.0 mg/kg | Single SQ injection on day 1 | 1673 |
| 10 | AC911872 | 9.0 mg/kg | Single SQ injection on day 1 | 1674 |
| 11 | AC911873 | 9.0 mg/kg | Single SQ injection on day 1 | 1811 |
| 12 | AC911874 | 9.0 mg/kg | Single SQ injection on day 1 | 2165 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 12, with average GLuc reflecting the normalized average value of GLuc. Inhibition of INHBE expression by an INHBE RNAi agent results in concomitant inhibition of GLuc expression, which is measured.

TABLE 12

| Average GLuc normalized to pre-treatment and saline control in INHBE-AAV-GLuc mice of Example 5. | | | | | | |
|---|---|---|---|---|---|---|
| | Day 8 | | Day 15 | | Day 22 | |
| Group ID | Avg GLuc | Std Dev | Avg GLuc | Std Dev | Avg GLuc | Std Dev |
| 1. Saline | 1.000 | 0.137 | 1.000 | 0.201 | 1.000 | 0.194 |
| 2. 9.0 mg/kg AC911861 | 0.680 | 0.382 | 0.709 | 0.221 | 0.745 | 0.322 |
| 3. 9.0 mg/kg AC911864 | 0.133 | 0.033 | 0.098 | 0.020 | 0.129 | 0.023 |
| 4. 9.0 mg/kg AC911866 | 0.323 | 0.045 | 0.223 | 0.029 | 0.317 | 0.037 |
| 5. 9.0 mg/kg AC911867 | 0.549 | 0.072 | 0.535 | 0.112 | 0.699 | 0.175 |
| 6. 9.0 mg/kg AC911868 | 0.580 | 0.100 | 0.622 | 0.099 | 0.768 | 0.184 |
| 7. 9.0 mg/kg AC911869 | 0.316 | 0.080 | 0.300 | 0.069 | 0.384 | 0.064 |
| 8. 9.0 mg/kg AC911870 | 0.448 | 0.107 | 0.409 | 0.048 | 0.613 | 0.050 |
| 9. 9.0 mg/kg AC911871 | 0.993 | 0.230 | 0.949 | 0.208 | 1.087 | 0.163 |
| 10. 9.0 mg/kg AC911872 | 0.770 | 0.077 | 0.723 | 0.109 | 1.020 | 0.143 |
| 11. 9.0 mg/kg AC911873 | 0.592 | 0.117 | 0.491 | 0.115 | 0.661 | 0.169 |
| 12. 9.0 mg/kg AC911874 | 0.139 | 0.021 | 0.162 | 0.033 | 0.270 | 0.053 |

Groups 2-12 showed reduction in AAV-INHBE at Day 8 and Day 15 compared to the saline control Group 1. Groups 2-8, 11, and 12 showed reduction in AAV-INHBE at Day 22 compared to the saline control Group 1. More specifically, AC911864 achieved ~90% inhibition on Day 15. Some of the INHBE RNAi agents achieved reduction of AAV-INHBE out to at least Day 22. Notably, Group 3 (9.0 mg/kg AC911864) achieved ~87% inhibition (0.129) at Day 22.

Example 6. In Vivo Testing of INHBE RNAi Agents in Mice

The INHBE-GLuc-AAV model as described in Example 2, above, was used. On Day −21, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 1.0 mg/kg), via subcutaneous (SQ) injection, at 250 μL per 25 g body weight injection volume. The dosing regimen was in accordance with Table 13 below.

TABLE 13

| Dosing Groups of Example 6. | | | | |
|---|---|---|---|---|
| Group ID | RNAi Agent | Dose | Dosing Regimen | Targeted Position of INHBE Seq ID No. 1 |
| 1 | Saline | N/A | Single SQ injection on day 1 | N/A |
| 2 | AC911864 | 1.0 mg/kg | Single SQ injection on day 1 | 1217 |
| 3 | AC912189 | 1.0 mg/kg | Single SQ injection on day 1 | 1217 |
| 4 | AC004045 | 1.0 mg/kg | Single SQ injection on day 1 | 1217 |
| 5 | AC004046 | 1.0 mg/kg | Single SQ injection on day 1 | 1217 |
| 6 | AC004047 | 1.0 mg/kg | Single SQ injection on day 1 | 1217 |
| 7 | AC911856 | 1.0 mg/kg | Single SQ injection on day 1 | 643 |
| 8 | AC912695 | 1.0 mg/kg | Single SQ injection on day 1 | 643 |
| 9 | AC004005 | 1.0 mg/kg | Single SQ injection on day 1 | 643 |
| 10 | AC004006 | 1.0 mg/kg | Single SQ injection on day 1 | 643 |
| 11 | AC004007 | 1.0 mg/kg | Single SQ injection on day 1 | 643 |
| 12 | AC004008 | 1.0 mg/kg | Single SQ injection on day 1 | 643 |
| 13 | AC004009 | 1.0 mg/kg | Single SQ injection on day 1 | 643 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 14, with average GLuc reflecting the normalized average value of GLuc. Inhibition of INHBE expression by an INHBE RNAi agent results in concomitant inhibition of GLuc expression, which is measured.

TABLE 14

Average GLuc normalized to pre-treatment and saline control in INHBE-AAV-GLuc mice of Example 6.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.288 | 1.000 | 0.237 | 1.000 | 0.326 |
| 2. 1.0 mg/kg AC911864 | 0.551 | 0.091 | 0.621 | 0.172 | 0.550 | 0.077 |
| 3. 1.0 mg/kg AC912189 | 0.493 | 0.185 | 0.434 | 0.075 | 0.528 | 0.118 |
| 4. 1.0 mg/kg AC004045 | 0.372 | 0.103 | 0.314 | 0.066 | 0.424 | 0.092 |

TABLE 14-continued

Average GLuc normalized to pre-treatment and saline control in INHBE-AAV-GLuc mice of Example 6.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 5. 1.0 mg/kg AC004046 | 0.456 | 0.098 | 0.324 | 0.102 | 0.434 | 0.116 |
| 6. 1.0 mg/kg AC004047 | 0.343 | 0.059 | 0.327 | 0.050 | 0.436 | 0.141 |
| 7. 1.0 mg/kg AC911856 | 0.811 | 0.141 | 0.764 | 0.094 | 0.935 | 0.121 |
| 8. 1.0 mg/kg AC912695 | 0.315 | 0.092 | 0.346 | 0.087 | 0.379 | 0.077 |
| 9. 1.0 mg/kg AC004005 | 0.381 | 0.122 | 0.381 | 0.099 | 0.408 | 0.106 |
| 10. 1.0 mg/kg AC004006 | 0.407 | 0.137 | 0.337 | 0.113 | 0.445 | 0.095 |
| 11. 1.0 mg/kg AC004007 | 0.455 | 0.098 | 0.321 | 0.033 | 0.417 | 0.110 |
| 12. 1.0 mg/kg AC004008 | 0.626 | 0.169 | 0.513 | 0.149 | 0.587 | 0.148 |
| 13. 1.0 mg/kg AC004009 | 0.615 | 0.176 | 0.537 | 0.066 | 0.695 | 0.161 |

Groups 2-13 showed reduction in AAV-INHBE at Day 8, 15, and 22 compared to the saline control Group 1. More specifically, AC004045 achieved ~68% inhibition on Day 15. The INHBE RNAi agents achieved reduction of AAV-INHBE out to at least Day 22. Notably, Group 8 (1.0 mg/kg AC912695) achieved ~62% inhibition (0.379) at Day 22.

Example 7. In Vivo Testing of INHBE RNAi Agents in Mice

The INHBE-GLuc-AAV model as described in Example 2, above, was used. On Day −21, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 1.0 mg/kg), via subcutaneous (SQ) injection, at 250 μL per 25 g body weight injection volume. The dosing regimen was in accordance with Table 15 below.

TABLE 15

| Dosing Groups of Example 7. | | | | |
|---|---|---|---|---|
| Group ID | RNAi Agent | Dose | Dosing Regimen | Targeted Position of INHBE Seq ID No. 1 |
| 1 | Saline | N/A | Single SQ injection on day 1 | N/A |
| 2 | AC911863 | 1.0 mg/kg | Single SQ injection on day 1 | 1202 |
| 3 | AC912707 | 1.0 mg/kg | Single SQ injection on day 1 | 1202 |
| 4 | AC004117 | 1.0 mg/kg | Single SQ injection on day 1 | 1202 |
| 5 | AC004118 | 1.0 mg/kg | Single SQ injection on day 1 | 1202 |
| 6 | AC004119 | 1.0 mg/kg | Single SQ injection on day 1 | 1202 |
| 7 | AC912692 | 1.0 mg/kg | Single SQ injection on day 1 | 402 |
| 8 | AC003827 | 1.0 mg/kg | Single SQ injection on day 1 | 402 |

TABLE 15-continued

Dosing Groups of Example 7.

| Group ID | RNAi Agent | Dose | Dosing Regimen | Targeted Position of INHBE Seq ID No. 1 |
|---|---|---|---|---|
| 9 | AC004179 | 1.0 mg/kg | Single SQ injection on day 1 | 402 |
| 10 | AC004180 | 1.0 mg/kg | Single SQ injection on day 1 | 402 |
| 11 | AC004181 | 1.0 mg/kg | Single SQ injection on day 1 | 402 |
| 12 | AC004182 | 1.0 mg/kg | Single SQ injection on day 1 | 402 |
| 13 | AC004183 | 1.0 mg/kg | Single SQ injection on day 1 | 402 |
| 14 | AC004184 | 1.0 mg/kg | Single SQ injection on day 1 | 402 |
| 15 | AC004185 | 1.0 mg/kg | Single SQ injection on day 1 | 402 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 16, with average GLuc reflecting the normalized average value of GLuc. Inhibition of INHBE expression by an INHBE RNAi agent results in concomitant inhibition of GLuc expression, which is measured.

TABLE 16

Average GLuc normalized to pre-treatment and saline control in INHBE-AAV-GLuc mice of Example 7.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.259 | 1.000 | 0.189 | 1.000 | 0.068 |
| 2. 1.0 mg/kg AC911863 | 0.638 | 0.112 | 0.704 | 0.114 | 0.728 | 0.158 |
| 3. 1.0 mg/kg AC912707 | 0.463 | 0.067 | 0.371 | 0.052 | 0.505 | 0.009 |
| 4. 1.0 mg/kg AC004117 | 0.658 | 0.141 | 0.614 | 0.176 | 0.769 | 0.177 |
| 5. 1.0 mg/kg AC004118 | 0.510 | 0.051 | 0.477 | 0.095 | 0.569 | 0.181 |
| 6. 1.0 mg/kg AC004119 | 0.468 | 0.041 | 0.622 | 0.088 | 0.660 | 0.125 |
| 7. 1.0 mg/kg AC912692 | 0.505 | 0.169 | 0.521 | 0.253 | 0.552 | 0.237 |
| 8. 1.0 mg/kg AC003827 | 0.424 | 0.043 | 0.505 | 0.078 | 0.453 | 0.082 |
| 9. 1.0 mg/kg AC004179 | 0.499 | 0.151 | 0.448 | 0.071 | 0.461 | 0.087 |
| 10. 1.0 mg/kg AC004180 | 0.438 | 0.086 | 0.679 | 0.146 | 0.641 | 0.209 |
| 11. 1.0 mg/kg AC004181 | 0.483 | 0.061 | 0.432 | 0.052 | 0.490 | 0.103 |
| 12. 1.0 mg/kg AC004182 | 0.486 | 0.147 | 0.539 | 0.095 | 0.743 | 0.084 |
| 13. 1.0 mg/kg AC004183 | 0.453 | 0.058 | 0.422 | 0.065 | 0.496 | 0.075 |
| 14. 1.0 mg/kg AC004184 | 0.431 | 0.045 | 0.477 | 0.050 | 0.482 | 0.043 |
| 15. 1.0 mg/kg AC004185 | 0.355 | 0.070 | 0.321 | 0.055 | 0.410 | 0.112 |

Groups 2-15 showed reduction in AAV-INHBE at Day 8, 15, and 22 compared to the saline control Group 1. More specifically, AC004185 achieved ~68% inhibition on Day 15. The INHBE RNAi agents achieved reduction of AAV-INHBE out to at least Day 22. Notably, Group 15 (1.0 mg/kg AC004185) achieved ~59% inhibition (0.410) at Day 22.

Example 8. In Vivo Testing of INHBE RNAi Agents in Mice

The INHBE-GLuc-AAV model as described in Example 2, above, was used. On Day −21, eight (n=8) (for Group 1) or four (n=4) (for Groups 2-10) male C57bl/6 mice were dosed with ~5×10^12 GC/kg INHBE-Gluc AAV8, via intravenous (IV) injection. At Day 1, the mice were dosed with either saline or with INHBE RNAi agents formulated in saline (at 1.0 mg/kg), via subcutaneous (SQ) injection, at 250 μL per 25 g body weight injection volume. The dosing regimen was in accordance with Table 17 below.

TABLE 17

Dosing Groups of Example 8.

| Group ID | RNAi Agent | Dose | Dosing Regimen | Targeted Position of INHBE Seq ID No. 1 |
|---|---|---|---|---|
| 1 | Saline | N/A | Single SQ injection on day 1 | N/A |
| 2 | AC911874 | 1.0 mg/kg | Single SQ injection on day 1 | 2165 |
| 3 | AC004284 | 1.0 mg/kg | Single SQ injection on day 1 | 2165 |
| 4 | AC004285 | 1.0 mg/kg | Single SQ injection on day 1 | 2165 |
| 5 | AC004286 | 1.0 mg/kg | Single SQ injection on day 1 | 2165 |
| 6 | AC912692 | 1.0 mg/kg | Single SQ injection on day 1 | 402 |
| 7 | AC003827 | 1.0 mg/kg | Single SQ injection on day 1 | 402 |
| 8 | AC004324 | 1.0 mg/kg | Single SQ injection on day 1 | 402 |
| 9 | AC004325 | 1.0 mg/kg | Single SQ injection on day 1 | 402 |
| 10 | AC004326 | 1.0 mg/kg | Single SQ injection on day 1 | 402 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 18, with average GLuc reflecting the normalized average value of GLuc. Inhibition of INHBE expression by an INHBE RNAi agent results in concomitant inhibition of GLuc expression, which is measured.

TABLE 18

Average GLuc normalized to pre-treatment and saline control in INHBE-AAV-GLuc mice of Example 8.

| Group ID | Day 8 Avg GLuc | Day 8 Std Dev | Day 15 Avg GLuc | Day 15 Std Dev | Day 22 Avg GLuc | Day 22 Std Dev |
|---|---|---|---|---|---|---|
| 1. Saline | 1.000 | 0.106 | 1.000 | 0.079 | 1.000 | 0.125 |
| 2. 1.0 mg/kg AC911874 | 0.600 | 0.070 | 0.623 | 0.137 | 0.768 | 0.056 |
| 3. 1.0 mg/kg AC004284 | 0.350 | 0.057 | 0.316 | 0.029 | 0.476 | 0.076 |
| 4. 1.0 mg/kg AC004285 | 0.260 | 0.044 | 0.217 | 0.058 | 0.333 | 0.063 |
| 5. 1.0 mg/kg AC004286 | 0.302 | 0.071 | 0.298 | 0.062 | 0.506 | 0.014 |
| 6. 1.0 mg/kg AC912692 | 0.327 | 0.031 | 0.258 | 0.037 | 0.425 | 0.068 |
| 7. 1.0 mg/kg AC003827 | 0.358 | 0.063 | 0.281 | 0.072 | 0.399 | 0.061 |
| 8. 1.0 mg/kg AC004324 | 0.337 | 0.036 | 0.327 | 0.058 | 0.441 | 0.012 |
| 9. 1.0 mg/kg AC004325 | 0.292 | 0.062 | 0.318 | 0.068 | 0.406 | 0.095 |
| 10. 1.0 mg/kg AC004326 | 0.332 | 0.086 | 0.340 | 0.053 | 0.450 | 0.043 |

Groups 2-10 showed reduction in AAV-INHBE at Day 8, 15, and 22 compared to the saline control Group 1. More specifically, AC004285 achieved ~78% inhibition on Day 15. The INHBE RNAi agents achieved reduction of AAV-INHBE out to at least Day 22. Notably, Group 4 (1.0 mg/kg AC004285) achieved ~67% inhibition (0.333) at Day 22.

Example 9. In Vivo Testing of INHBE RNAi Agents in Cynomolgus Monkeys

INHBE RNAi agents were tested in Cynomolgus monkeys for inhibition of NHBE. On Day 1 and Day 29, two (n=2) or three (n=3) female Cynomolgus monkeys for each test group were dosed with INHBE RNAi agents formulated in saline (at 3.0 mg/kg), via subcutaneous (SQ) injection with syringe and needle in the mid-scapular region, at 0.3 mL/kg dose volume. Liver biopsies were collected from all test animals on Day −7 (pre-dose), 15, 29, 57, and 85. All animals were fasted for at least 12 but not more than 18 hours prior to sedation and collection of liver biopsies. The dosing regimen was in accordance with Table 19 below.

TABLE 19

Dosing for Cynomolgus animals of Example 9.

| Group | Dose (RNAi Agent) | Targeted Position of INHBE (Seq ID No. 1) | Dosing Route | # of Animals (n=) |
|---|---|---|---|---|
| 1 | 3.0 mg/kg AC004047 | 1217 | Day 1 & 29 SQ Injection | n = 2 |
| 2 | 3.0 mg/kg AC004007 | 643 | Day 1 & 29 SQ Injection | n = 3 |
| 3 | 3.0 mg/kg AC912707 | 1202 | Day 1 & 29 SQ Injection | n = 3 |
| 4 | 3.0 mg/kg AC004285 | 2165 | Day 1 & 29 SQ Injection | n = 2 |

Before each SQ injection, the test animals were first sedated. Sedation was accomplished using Ketamine HCl (10 mg/kg), administered as an intramuscular (IM) injection (none was injected into the quadriceps). Individual doses of INHBE RNAi agents were calculated based on the body weights recorded on each day of dosing.

For each animal, liver biopsy samples (approximately 40 mg each (30 to 60 mg; ±10%)) were collected for exploratory gene knockdown analysis.

Serum blood was collected on Day −7, Day 1, Day 15, Day 29, Day 57, and Day 85, prior to liver biopsy sample collections or dose administration (when applicable), and from any animals found in moribund condition or sacrificed at an unscheduled interval. The collection site was the femoral vein, with a saphenous vein as an alternative collection site.

The liver biopsies and serum collected from the test animals were used for analysis for INHBE expression and additional biological parameters. Liver biopsies were collected on Day −7, Day 15, Day 29 (prior to dosing), Day 57, and Day 85.

Liver biopsies were collected as a sedated procedure. Animals were fasted overnight (at least 12 hours but less than 18 hours) prior to each liver biopsy collection. For each animal, collected liver biopsy samples were of approximately 40 mg each (30 to 60 mg; ±10%).

The collected liver biopsies were analyzed for INHBE expression and additional biological parameters. Liver cINHBE mRNA expression levels were quantified via qPCR, using cARL1 as endogenous control gene, normalized to Day-7 (pre-dose). The qPCR INHBE expression data is shown in the following Table 20.

TABLE 20

Liver INHBE expression of Cynomolgus monkeys of Example 9.

| Group ID | Day −7 Rel. Exp. | Day −7 Error Low | Day −7 Error High | Day 15 Rel. Exp. | Day 15 Error Low | Day 15 Error High |
|---|---|---|---|---|---|---|
| 1. 3.0 mg/kg AC004047 | 1.000 | 0.116 | 0.131 | 0.631 | 0.057 | 0.062 |
| 2. 3.0 mg/kg AC004007 | 1.000 | 0.280 | 0.390 | 0.355 | 0.122 | 0.185 |
| 3. 3.0 mg/kg AC912707 | 1.000 | 0.304 | 0.437 | 0.543 | 0.079 | 0.093 |
| 4. 3.0 mg/kg AC004285 | 1.000 | 0.087 | 0.095 | 0.351 | 0.039 | 0.044 |

| Group ID | Day 29 Rel. Exp. | Day 29 Error Low | Day 29 Error High | Day 57 Rel. Exp. | Day 57 Error Low | Day 57 Error High |
|---|---|---|---|---|---|---|
| 1. 3.0 mg/kg AC004047 | 0.665 | 0.106 | 0.125 | 0.692 | 0.139 | 0.173 |
| 2. 3.0 mg/kg AC004007 | 0.351 | 0.199 | 0.458 | 0.258 | 0.111 | 0.194 |
| 3. 3.0 mg/kg AC912707 | 0.688 | 0.146 | 0.185 | 0.545 | 0.054 | 0.060 |
| 4. 3.0 mg/kg AC004285 | 0.305 | 0.061 | 0.077 | 0.174 | 0.032 | 0.040 |

| Group ID | Day 85 Rel. Exp. | Day 85 Error Low | Day 85 Error High |
|---|---|---|---|
| 1. 3.0 mg/kg AC004047 | 0.242 | 0.181 | 0.715 |
| 2. 3.0 mg/kg AC004007 | 0.370 | 0.111 | 0.159 |
| 3. 3.0 mg/kg AC912707 | 0.604 | 0.127 | 0.160 |
| 4. 3.0 mg/kg AC004285 | 0.325 | 0.046 | 0.054 |

INHBE RNAi agents achieved deep knockdown of INHBE transcripts for a duration of at least 85 days, with two subcutaneous SQ injections at 3.0 mg/kg on Day 1 and Day 29. Groups 1-4 showed reduction in INHBE at Day 15, 29, 57, and 85 compared to the pre-dose Day −7. More specifically, AC004047 achieved ~76% inhibition (0.242) on Day 85; AC004285 achieved ~83% inhibition (0.174) at Day 57 (at nadir).

Example 10. In Vivo Testing of INHBE RNAi Agents in Mice

INHBE RNAi agents were tested in vivo in diet-induced obese (DIO) C57 albino mice. On Day 1, 8, 15, 22, 29, 36, 43, 50, 57, 64, 71, 78, 85, 92, 99, 106, and 113, ten (n=10) female DIO mice in each group were dosed, via subcutaneous (SQ) injection, with either saline (Group 1) or INHBE RNAi agent formulated in saline (at 9.0 mg/kg) (Group 2). On Day 1 and continuing daily until Day 119, the DIO mice were dosed, via subcutaneous (SQ) injection, with Tirzepatide (at 0.42 mg/kg) (Group 3); Group 3 mice were dosed daily with Tirzepatide, except for days that fell on weekends. On Day 100, all test groups (Groups 1-3) were dosed, via oral gavage, 15% glucose solution at 200 uL/30 g body weight (BW). Dosing was in accordance with Table 21 below.

RNAi agent AC004053 is specific to mouse INHBE mRNA and targets position 585 of GenBank NM_008382.3.

TABLE 21

Dosing Groups of Example 10.

| Group ID | RNAi Agent | RNAi Agent Dose | Dose Volume | Dosing Regimen (RNAi Agent) | Dosing Regimen | # of Animals (n=) |
|---|---|---|---|---|---|---|
| 1 | Saline | N/A | 5.0 mL/kg | SQ injection on Day 1, 8, 15, 22, 29, 36, 43, 50, 57, 64, 71, 78, 85, 92, 99, 106, 113 | Oral gavage 15% glucose solution on Day 100 at 200 uL/30 g BW | n = 10 |
| 2 | AC004053 | 9.0 mg/kg | 5.0 mL/kg | SQ injection on Day 1, 8, 15, 22, 29, 36, 43, 50, 57, 64, 71, 78, 85, 92, 99, 106, 113 | Oral gavage 15% glucose solution on Day 100 at 200 uL/30 g BW | n = 10 |
| 3 | Tirzepatide | 0.42 mg/kg | 5.0 mL/kg | SQ injection daily starting Day 1 (except weekends) | Oral gavage 15% glucose solution on Day 100 at 200 uL/30 g BW | n = 10 |

DIO mice were received and acclimated at Day −9, and the test animals' body weight recorded on Day −7. On Day −5, 29, and 100 (before blood collection, before glucose dose), all test animals were fasted for six (6) hours. On Day −5, 29, and 100 (after fasting, before glucose dose), blood was collected from all animals for fasting glucose and serum. On Day 100, post glucose dose, blood was further collected at 15, 30, 60, 90, and 120 minutes post glucose bolus, to test for glucose tolerance test (GTT) by test strip. On Day 119, all test animals were sacrificed, and liver tissue harvested.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

Liver IHBE mRNA expression levels were quantified via qPCR, using mActB as endogenous control gene, normalized to Group 1 mice dosed with saline. The qPCR IHBE expression data is shown in the following Table 22.

TABLE 22

INHBE expression levels of mice of Example 10.

| Group ID | Day 119 Avg INHBE | Error Low | Error High |
|---|---|---|---|
| 1. Saline | 1.000 | 0.387 | 0.632 |
| 2. 9.0 mg/kg AC004053 | 0.056 | 0.018 | 0.028 |
| 3. 0.42 mg/kg Tirzepatide | 0.367 | 0.174 | 0.331 |

INHBE RNAi agent AC004053 showed significant inhibition of INHBE, achieving ~94% inhibition (0.056) at 9.0 mg/kg on Day 119.

On Day 119, the DIO mice were given a single dose, via intraperitoneal (IP) injection, 1.0 mg/kg body weight (at 20 mL/kg injection volume) of CL 316,243 β3-adrenergic agonist. At 30 minutes after CL 316,243 injection, the DIO test animals were sacrificed, and whole blood was collected.

From the collected blood samples, serum was analyzed for pharmacological and biological parameters. Serum non esterified fatty acids (NEFA) levels were quantified via Randox NEFA assay. Serum ketone levels were quantified via Randox D-3-Hydroxybutyrate (Ranbut) assay. All assays were performed in accordance with manufacturer's instructions. The serum assay results are shown in the following Table 23.

TABLE 23

Serum NEFA and ketone levels of mice of Example 10.

| Group ID | Day 119 NEFA | Std Dev +/− | Ketones | Std Dev +/− |
|---|---|---|---|---|
| 1. Saline | 1.4 | 0.2 | 1 | 0.3 |
| 2. 9.0 mg/kg AC004053 | 1.6 | 0.3 | 1.6 | 0.4 |
| 3. 0.42 mg/kg Tirzepatide | 0.7 | 0.2 | 0.9 | 0.5 |

DIO mice treated with INHBE RNAi agent AC004053 also improved the sensitivity of the DIO mice to catecholamine, as indicated by the increased circulating ketone levels.

In DIO mice, weekly dosing of the INHBE RNAi agent significantly suppressed body weight gain. As shown in FIG. 1A, over time, mice dosed with INHBE RNAi agent AC004053 showed less body weight gain than the saline control group, at ~20% less body weight gain than the control group at weeks 11-16. Significance level is denoted **=p<0.0001, *=p<0.001, **=p<0.01, *=p<0.05, and ns=not significant.

Figure 1B:
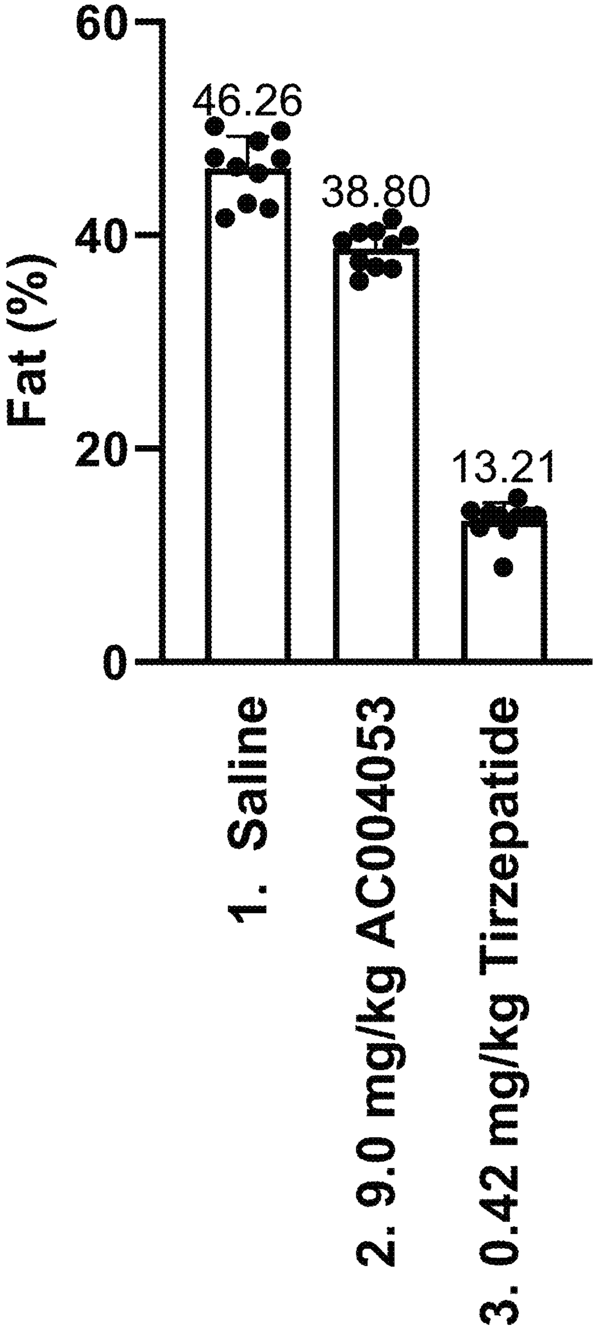
Figure 1C:
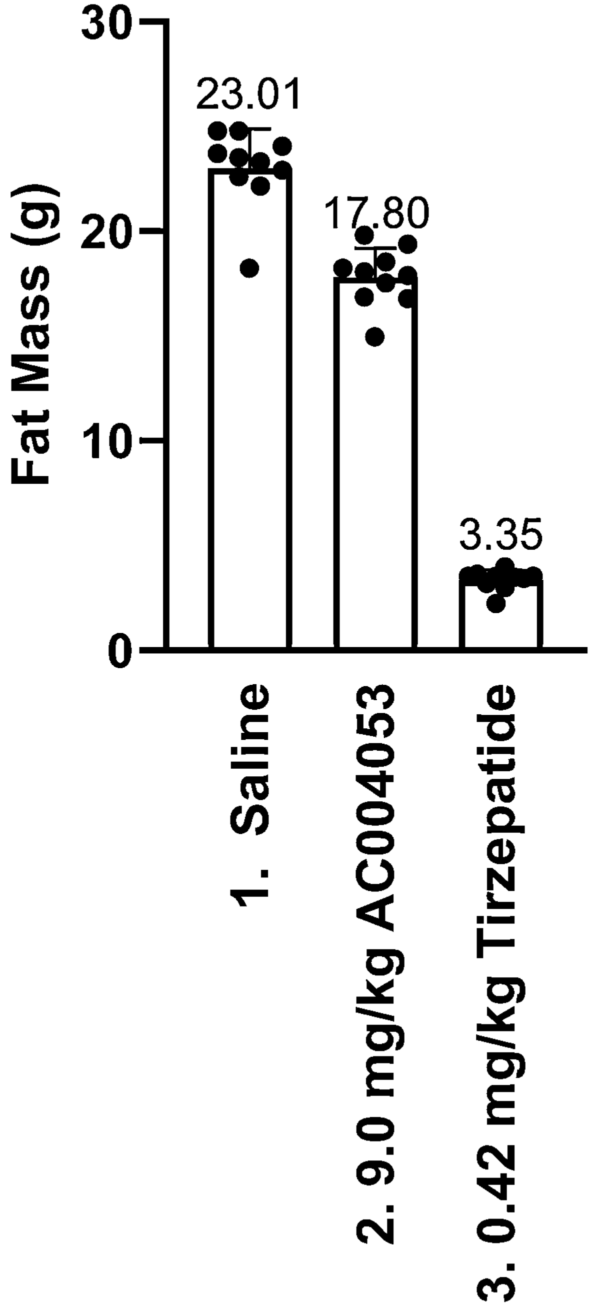
Figure 1D:
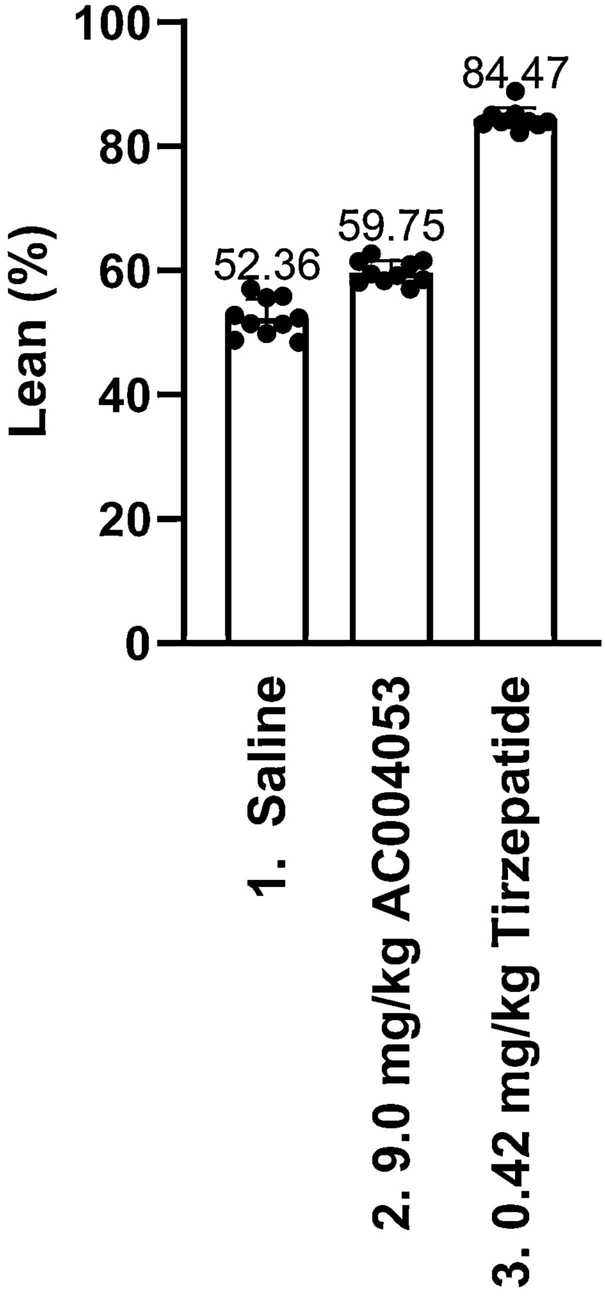
Figure 1E:
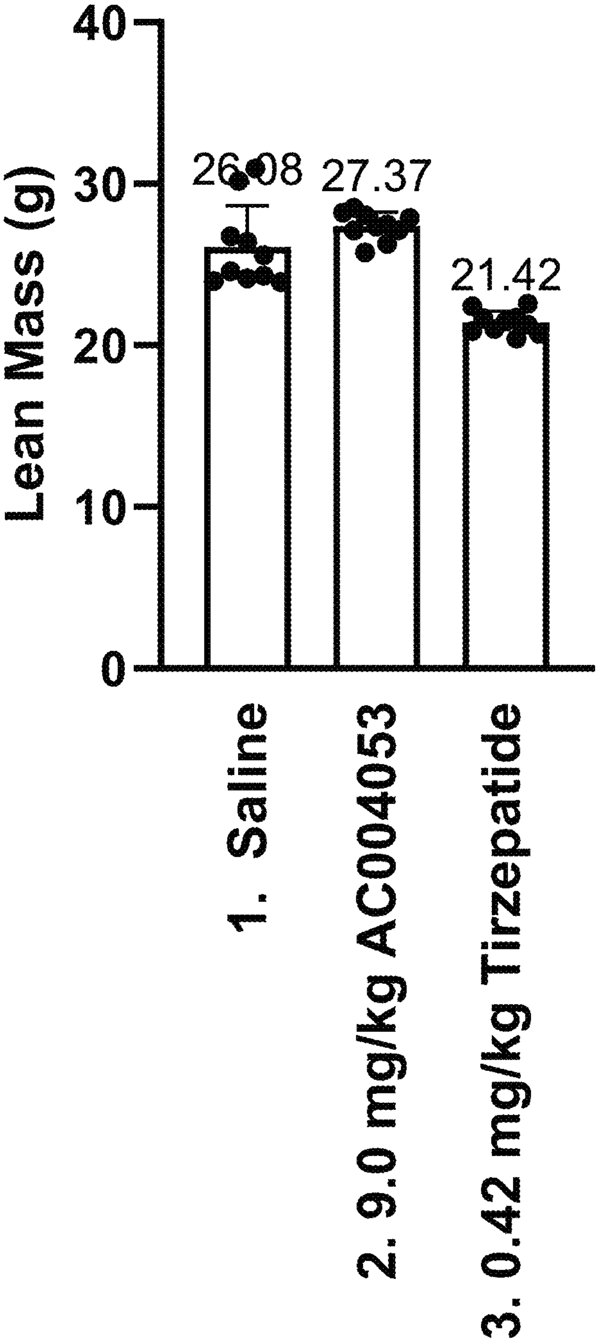

In DIO mice, weekly dosing of the INHBE RNAi agent significantly decreased fat mass. The DIO test mice were imaged via dual-energy X-ray absorptiometry (DEXA) scans on Day 91 and Day 119. DEXA scan data of Day 119 are presented in the following data. As shown in FIGS. 1B and 1C, weekly dosing of AC004053 showed decreased fat mass (both fat percentage and fat mass) compared to saline control group. DIO mice dosed with AC004053 maintained lean mass, as shown in FIGS. 1D and 1E (both lean percentage and lean mass).

Figure 1F:
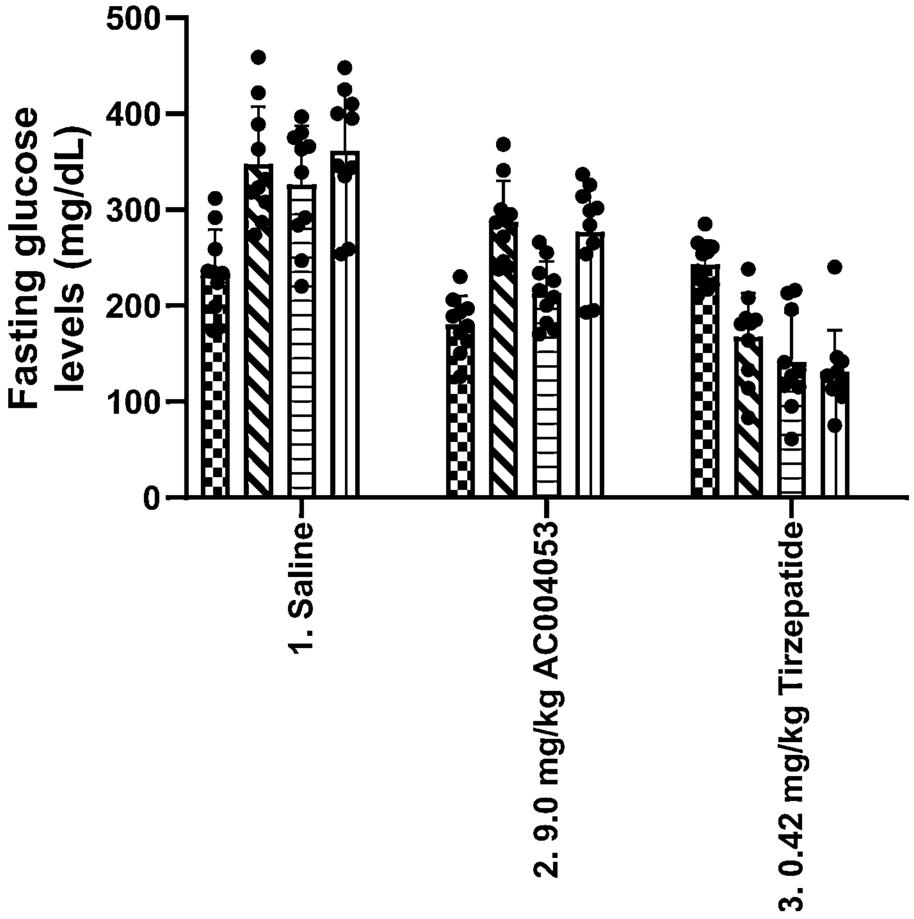
Figure 1G:
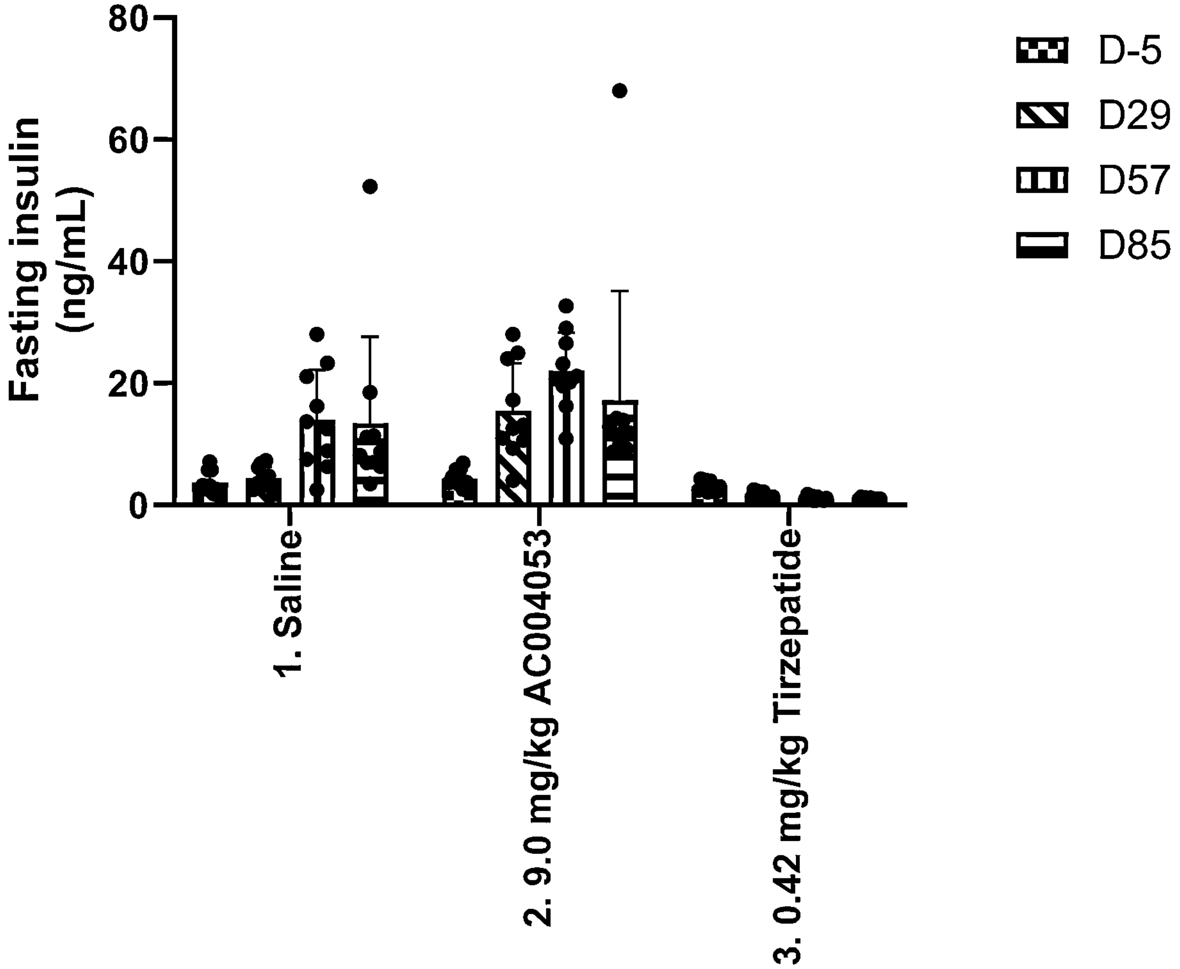
Figure 1H:
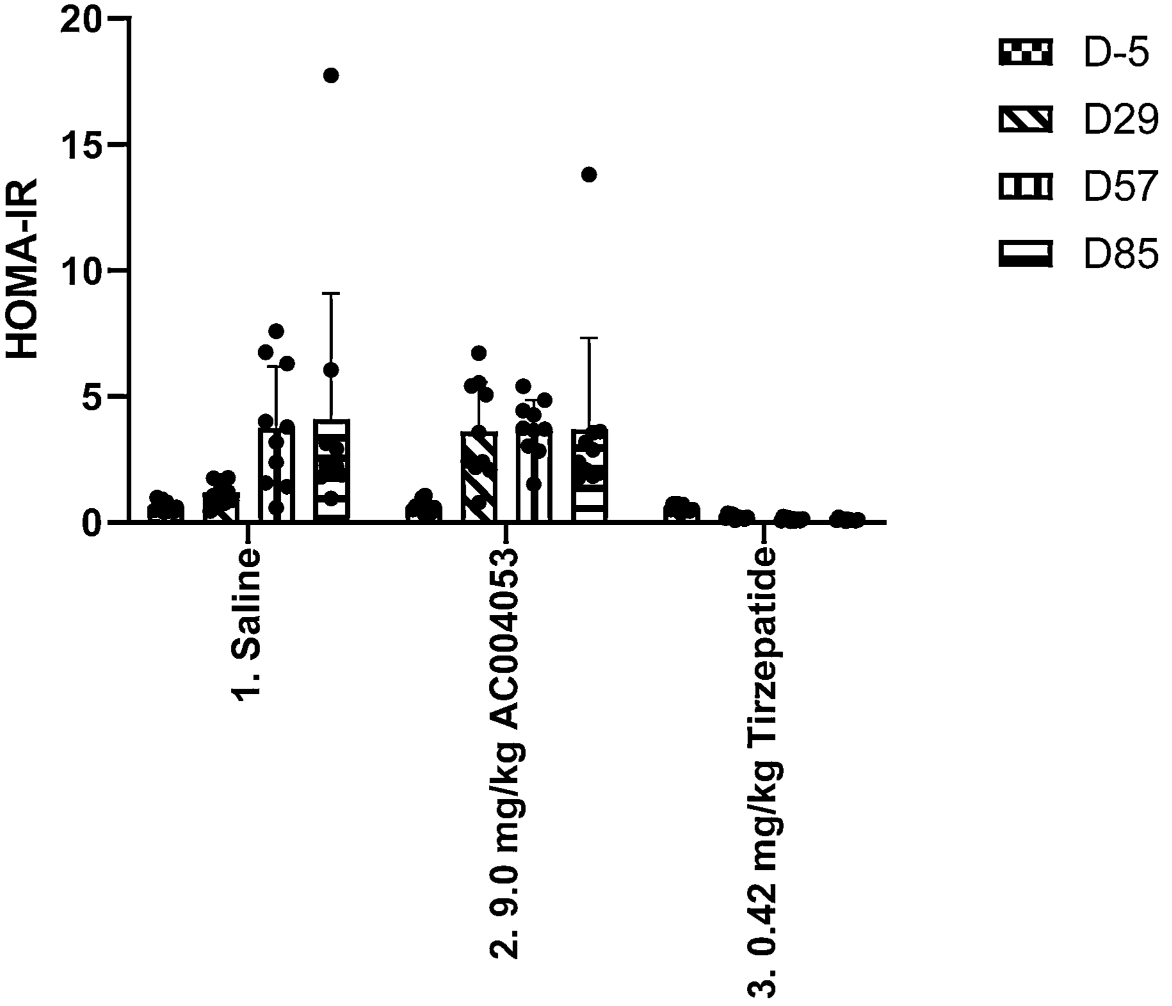
Figure 1I:
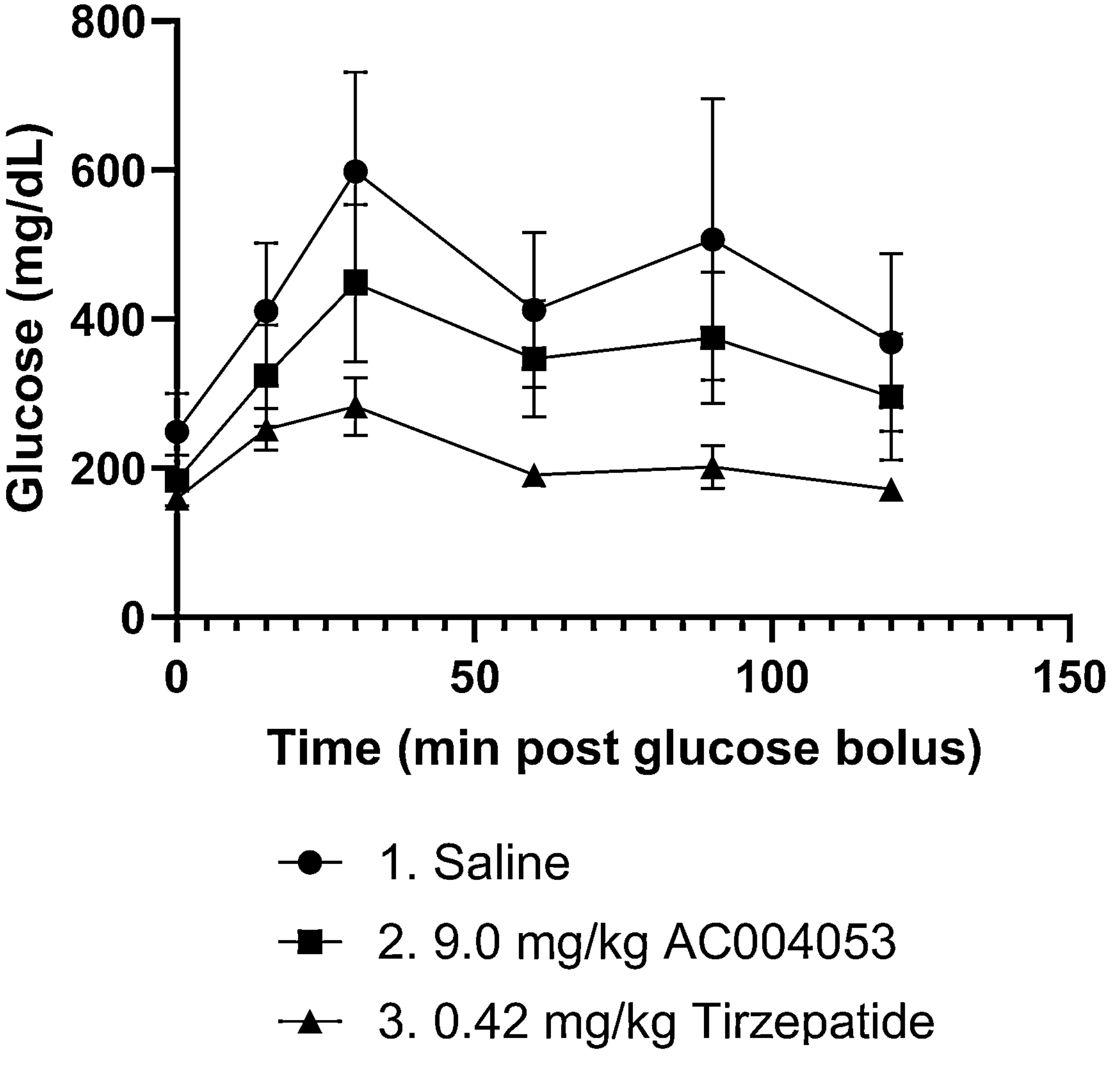
Figure 1J:
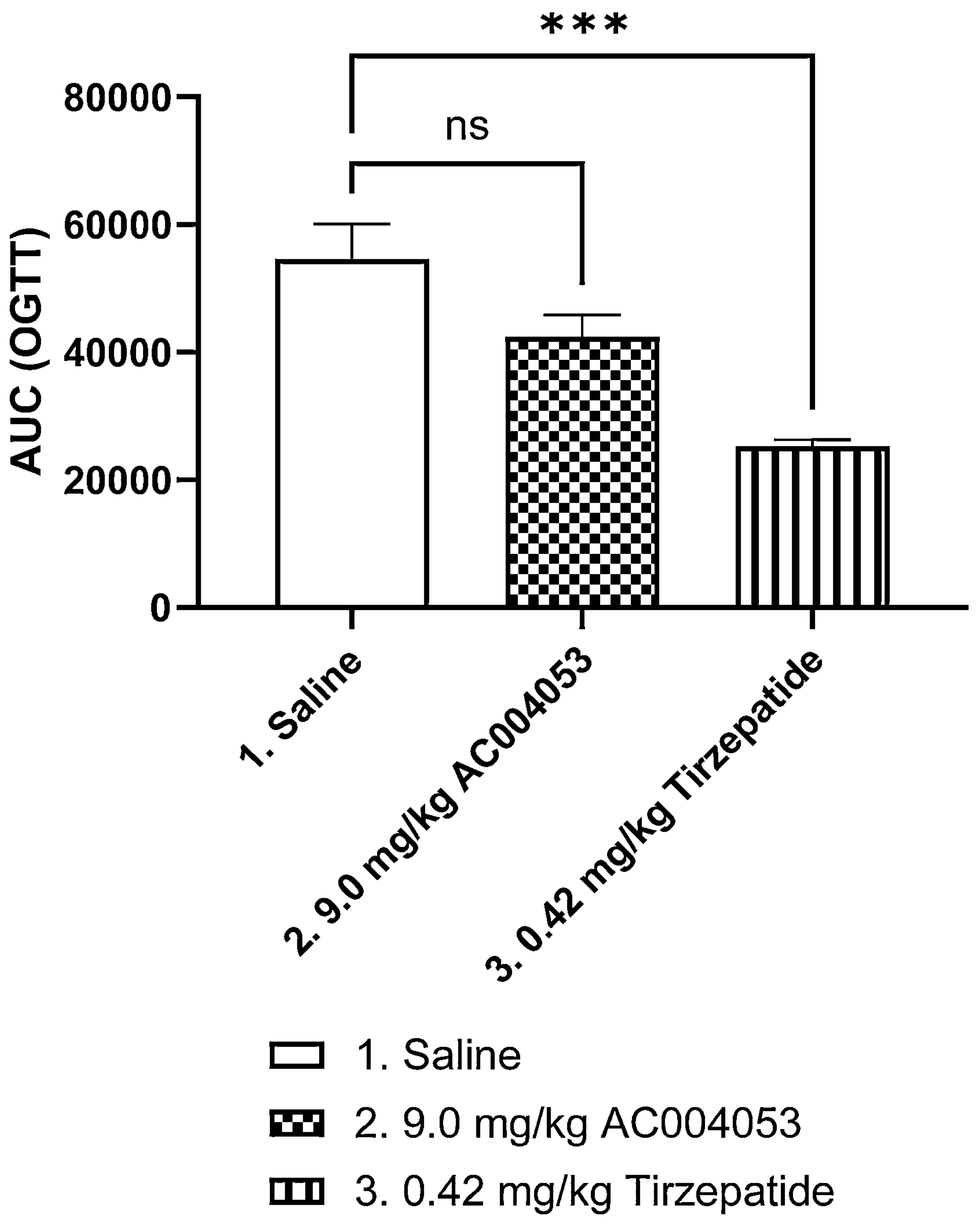

In DIO mice, weekly dosing of the INHBE RNAi agent maintained glucose homeostasis. DIO mice dosed with AC004053, in comparison with the saline control group, showed similar fasting glucose levels (FIG. 1F), similar fasting insulin levels (FIG. 1G), similar Homeostatic Model Assessment for Insulin Resistance (HOMA-IR) levels (FIG. 1H), similar glucose levels post glucose bolus (FIG. 1I), and similar glucose area under the curve (AUC) levels (FIG. 1J, as an oral glucose tolerance test). Significance level was calculated for glucose area under the curve and is denoted in FIG. 1J as **=p<0.0001, *=p<0.001, **=p<0.01, *=p<0.05, and ns=not significant.

These results demonstrate that knocking down INHBE has a significant pharmacological effect in reducing body weight in DIO mice.

Example 11. In Vivo Testing of INHBE RNAi Agents in Mice

INHBE RNAi agents were tested in vivo in genetically diabetic db/db mice. On Days 1, 8, 15, 22, 29, 36, 43, 50, 57, and 64, ten (n=10) male db/db mice were dosed in each group, via subcutaneous (SQ) injection, with either saline (Group 1) or INHBE RNAi agents (at 9.0 mg/kg) formulated in saline (Groups 2, 4, and 5). On Day 1 and continuing daily until Day 67, the db/db mice were dosed, via subcutaneous (SQ) injection, with Tirzepatide (at 0.14 mg/kg or 0.48 mg/kg) (Groups 3-5); Groups 3-5 mice were dosed daily with Tirzepatide, except for days that fell on weekends. On Day 29 and Day 57, all test groups (Groups 1-5) were dosed, via oral gavage, 15% glucose solution at 200 uL/30 g body weight (BW). Dosing was in accordance with Table 24 below.

RNAi agent AC004053 is specific to mouse INHBE mRNA and targets position 585 of GenBank NM_008382.3.

TABLE 24

Dosing Groups of Example 11.

| Group ID | RNAi Agent | RNAi Agent Dose | Dose Volume | Dosing Regimen (RNAi Agent) | Dosing Regimen | # of Animals (n=) |
|---|---|---|---|---|---|---|
| 1 | Saline | N/A | 5.0 mL/kg | SQ injection on Day 1, 8, 15, 22, 29, 36, 43, 50, 57, 64 | Oral gavage 15% glucose solution on Day 29 and 57 at 200 uL/30 g BW | n = 10 |
| 2 | AC004053 | 9.0 mg/kg | 5.0 mL/kg | SQ injection on Day 1, 8, 15, 22, 29, 36, 43, 50, 57, 64 | Oral gavage 15% glucose solution on Day 29 and 57 at 200 uL/30 g BW | n = 10 |
| 3 | Tirzepatide | 0.48 mg/kg | 5.0 mL/kg | SQ injection daily starting Day 1 (except weekends) | Oral gavage 15% glucose solution on Day 29 and 57 at 200 uL/30 g BW | n = 10 |
| 4 | AC004053 + Tirzepatide | 9.0 mg/kg 0.14 mg/kg | 5.0 mL/kg | AC004053: SQ injection on Day 1, 8, 15, 22, 29, 36, 43, 50, 57, 64; Tirzepatide: SQ injection daily starting Day 1 (except weekends) | Oral gavage 15% glucose solution on Day 29 and 57 at 200 uL/30 g BW | n = 10 |
| 5 | AC004053 + Tirzepatide | 9.0 mg/kg 0.48 mg/kg | 5.0 mL/kg | AC004053: SQ injection on Day 1, 8, 15, 22, 29, 36, 43, 50, 57, 64; Tirzepatide: SQ injection daily starting Day 1 (except weekends) | Oral gavage 15% glucose solution on Day 29 and 57 at 200 uL/30 g BW | n = 10 |

The db/db mice were received and acclimated at Day −14, and the test animals' body weight recorded on Day −11. On Day −11, 29, and 57 (before blood collection, before glucose dose), all test animals were fasted for six (6) hours. On Day −11. 29, 36, 57 (after fasting, before glucose dose, before RNAi agent/tirzepatide dose), blood was collected from all animals for fasting glucose and serum. On Day 29 and 57, post glucose dose, blood was further collected at 15, 30, 60, 90, and 120 minutes post glucose bolus, to test for glucose tolerance test (GTT) by test strip. On Day 67, all test animals were sacrificed, and liver tissue harvested.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

Liver INHBE mRNA expression levels were quantified via qPCR, using mActB as endogenous control gene, normalized to Group 1 mice dosed with saline. The qPCR INHBE expression data is shown in the following Table 25.

TABLE 25

INHBE expression levels of mice of Example 11.

| Group ID | Day 67 Avg INHBE | Day 67 Error Low | Day 67 Error High |
|---|---|---|---|
| 1. Saline | 1.000 | 0.396 | 0.655 |
| 2. 9.0 mg/kg AC004053 | 0.064 | 0.038 | 0.096 |
| 3. 0.48 mg/kg Tirzepatide | 0.698 | 0.318 | 0.584 |
| 4. 9.0 mg/kg AC004053 + 0.14 mg/kg Tirzepatide | 0.185 | 0.094 | 0.192 |
| 5. 9.0 mg/kg AC004053 + 0.48 mg/kg Tirzepatide | 0.126 | 0.070 | 0.155 |

INHBE RNAi agent AC004053 showed significant inhibition of NHBE, achieving ~93% inhibition (0.064) at 9.0 mg/kg on Day 67.

Figure 2A:
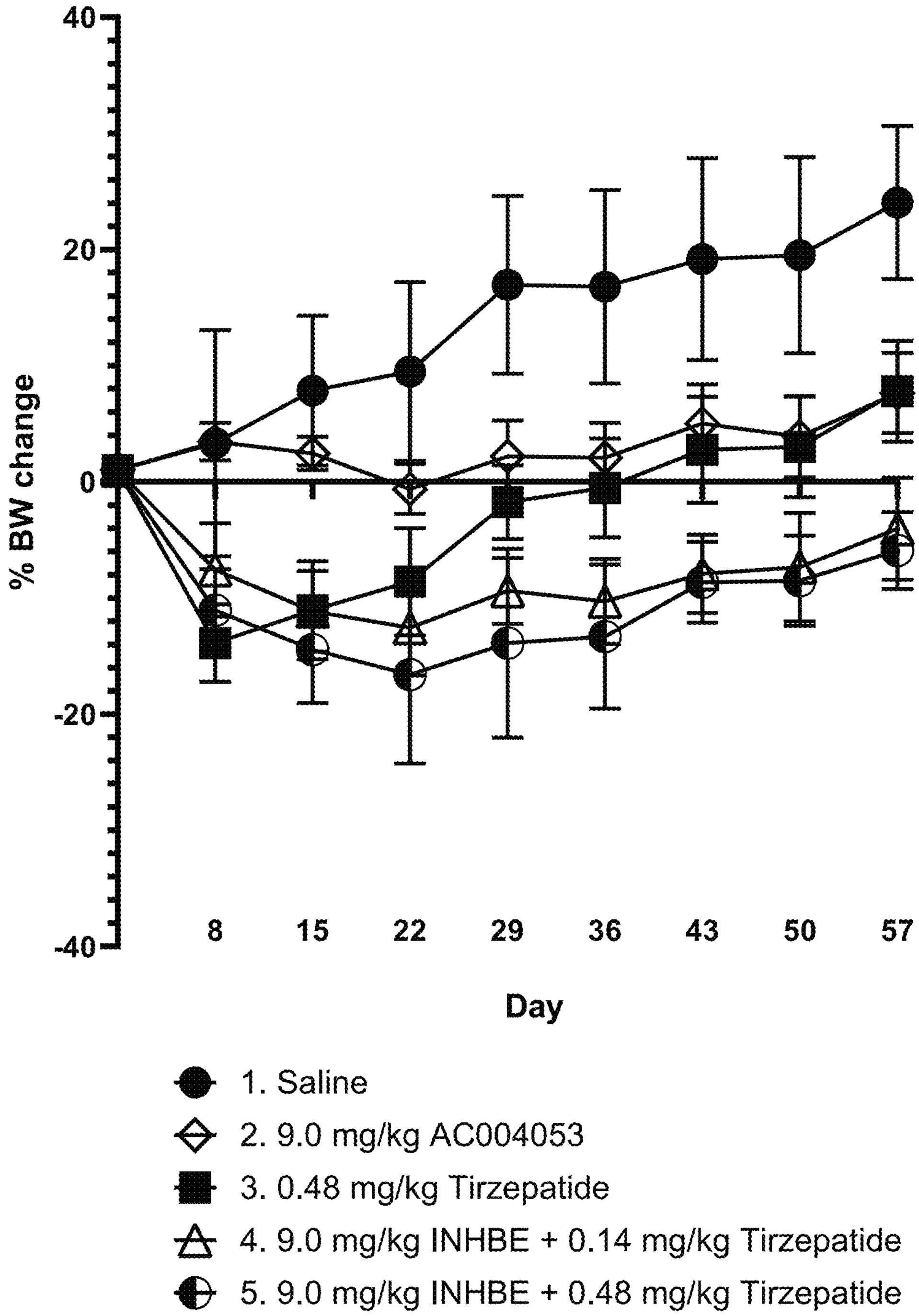

In db/db mice, weekly dosing of the INHBE RNAi agent significantly suppressed body weight gain. As shown in FIG. 2A, over time, mice dosed with INHBE RNAi agent AC004053 (Group 2, 9.0 mg/kg AC004053) showed less body weight gain than the saline control group, at ~10-15% less body weight gain than the control group at Day ~29-57.

Figure 2B:
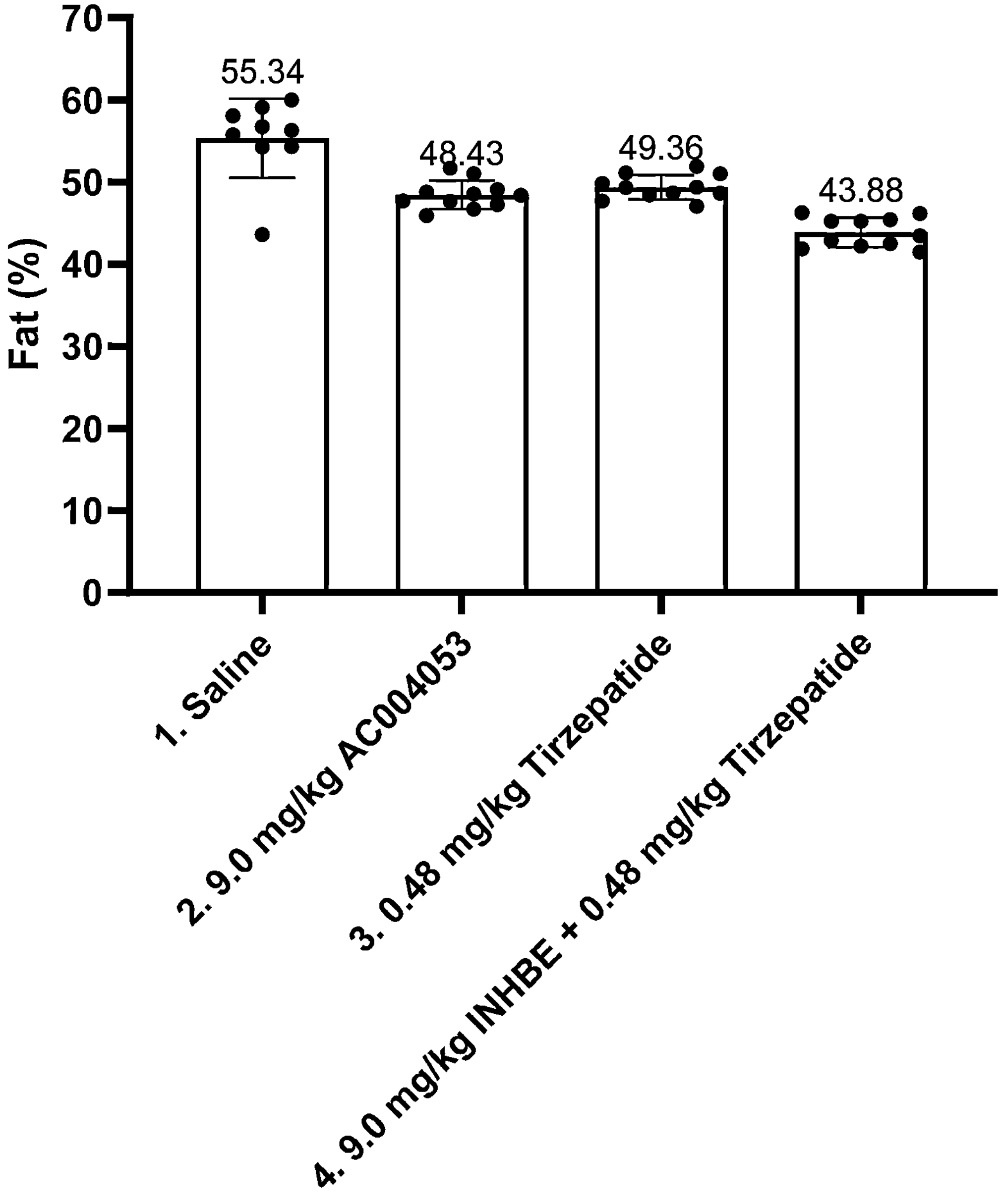
Figure 2C:
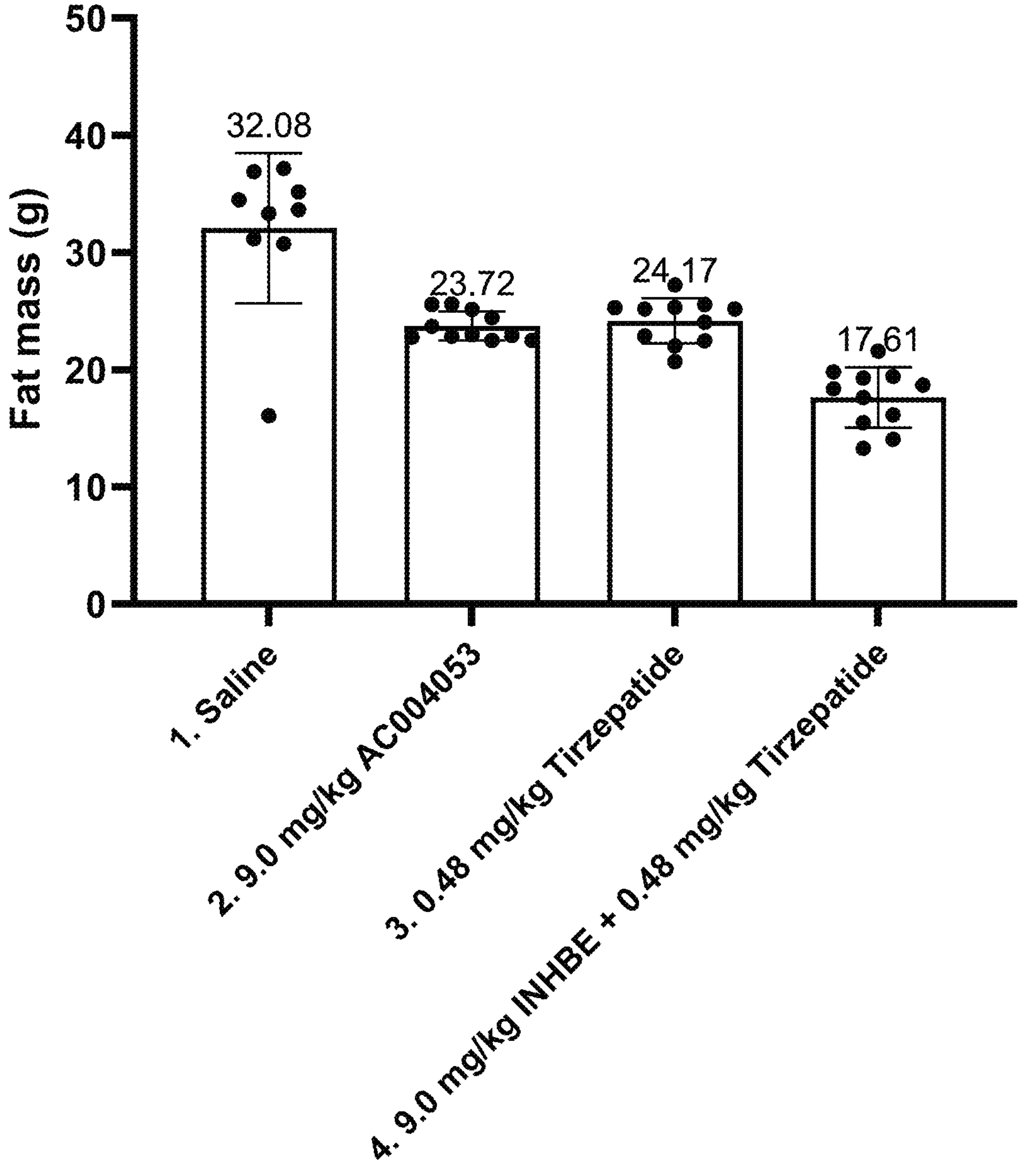
Figure 2D:
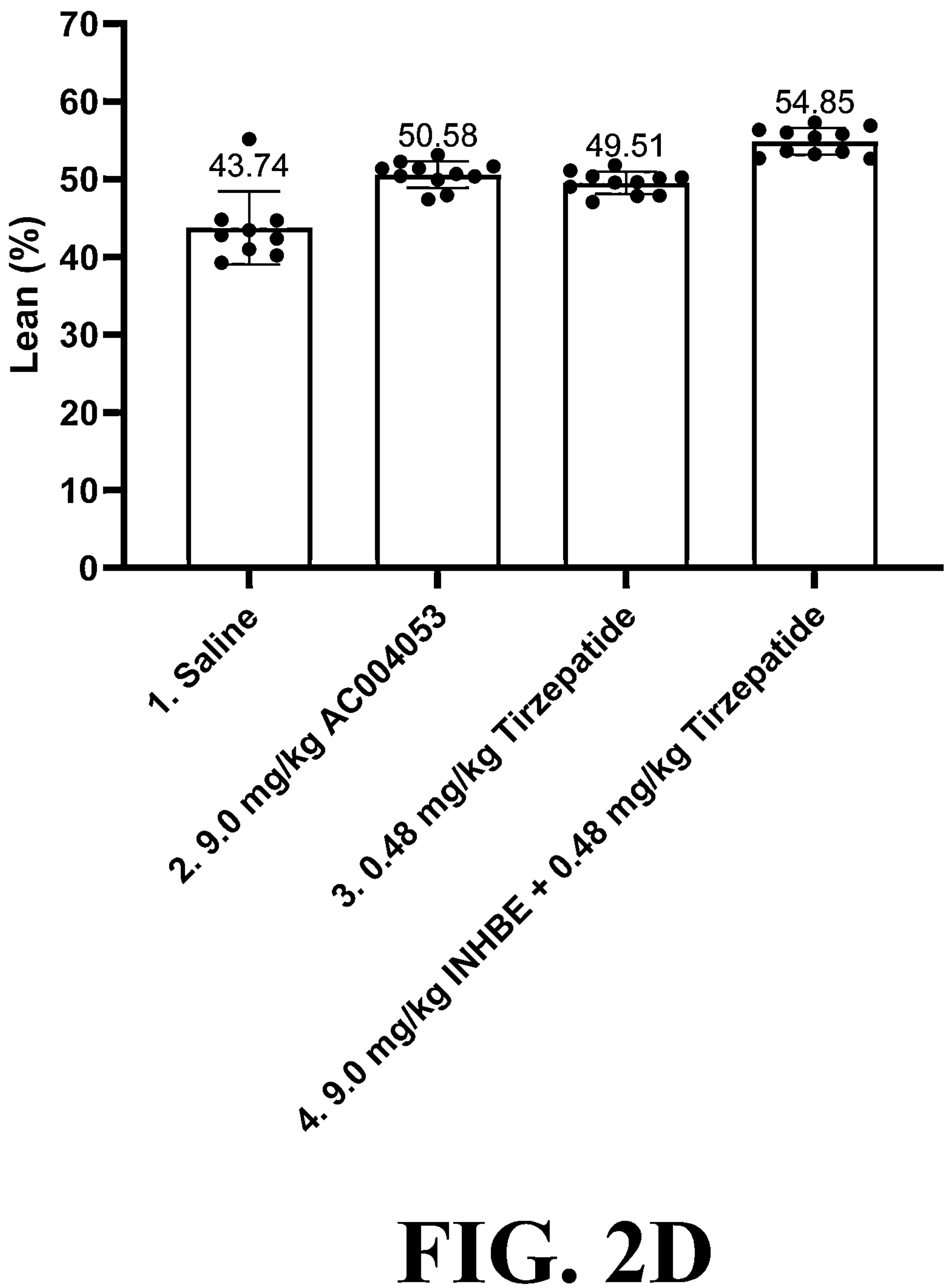
Figure 2E:
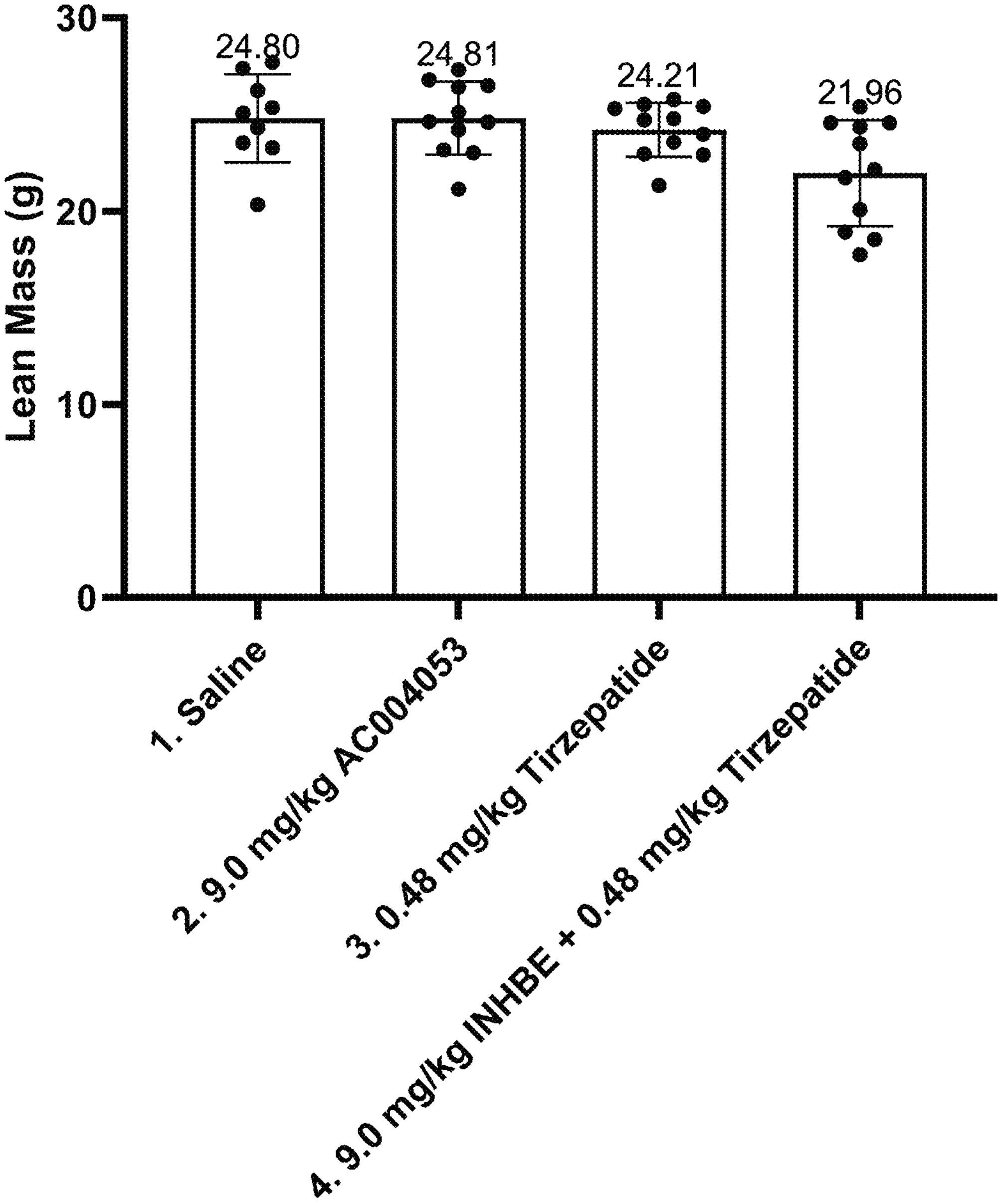

In db/db mice, weekly dosing of the INHBE RNAi agent significantly decreased fat mass. The db/db test mice were imaged via dual-energy X-ray absorptiometry (DEXA) scans on Day 47 and Day 67. DEXA scan data of Day 67 are presented in the following data. As shown in FIGS. 2B and 2C, weekly dosing of AC004053 (Group 2, 9.0 mg/kg AC004053) showed decreased fat mass (both fat percentage and fat mass) compared to saline control group. Db/db mice dosed with AC004053 maintained lean mass, as shown in FIGS. 2D and 2E (both lean percentage and lean mass).

Figure 2F:
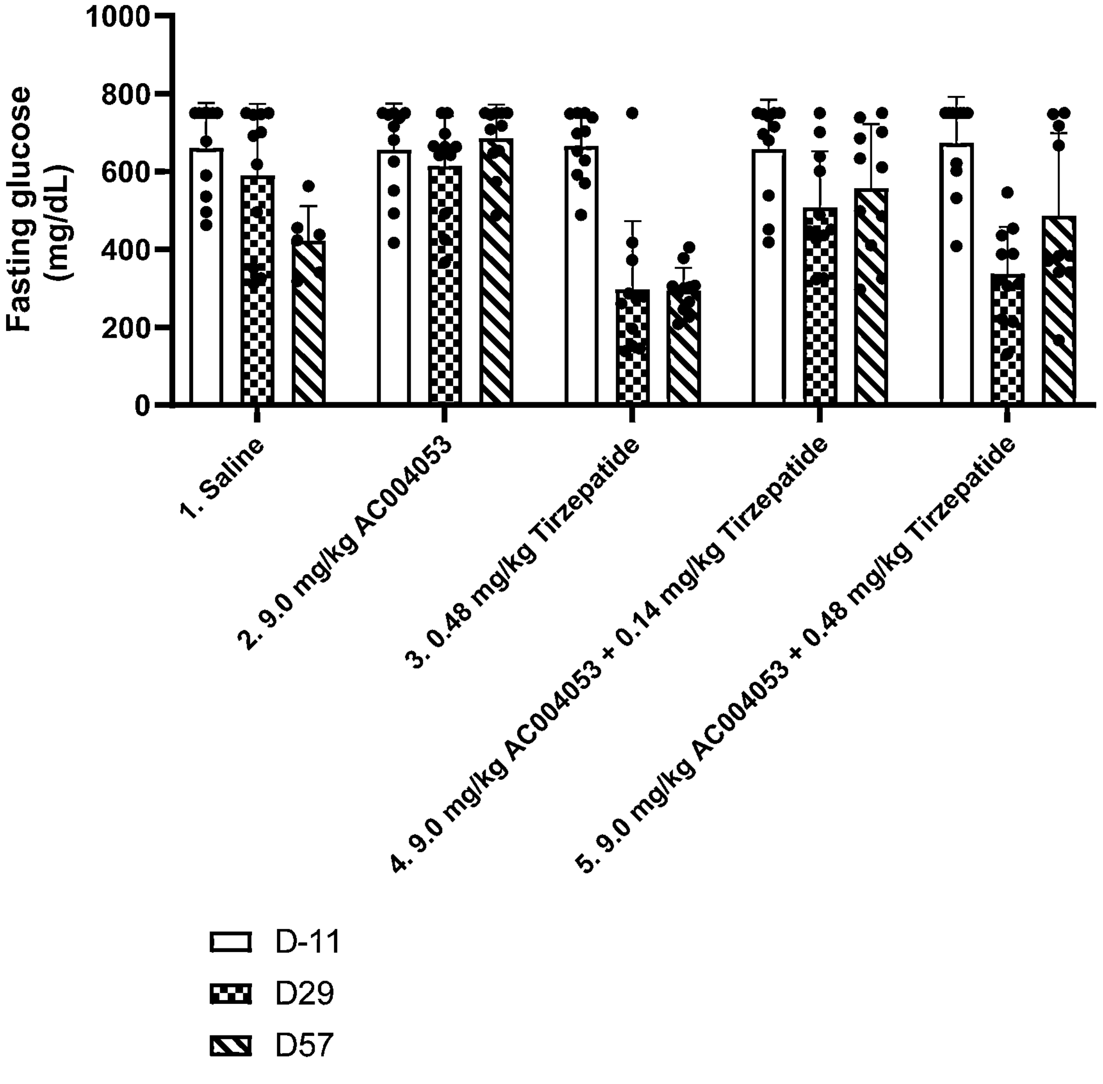
Figure 2G:
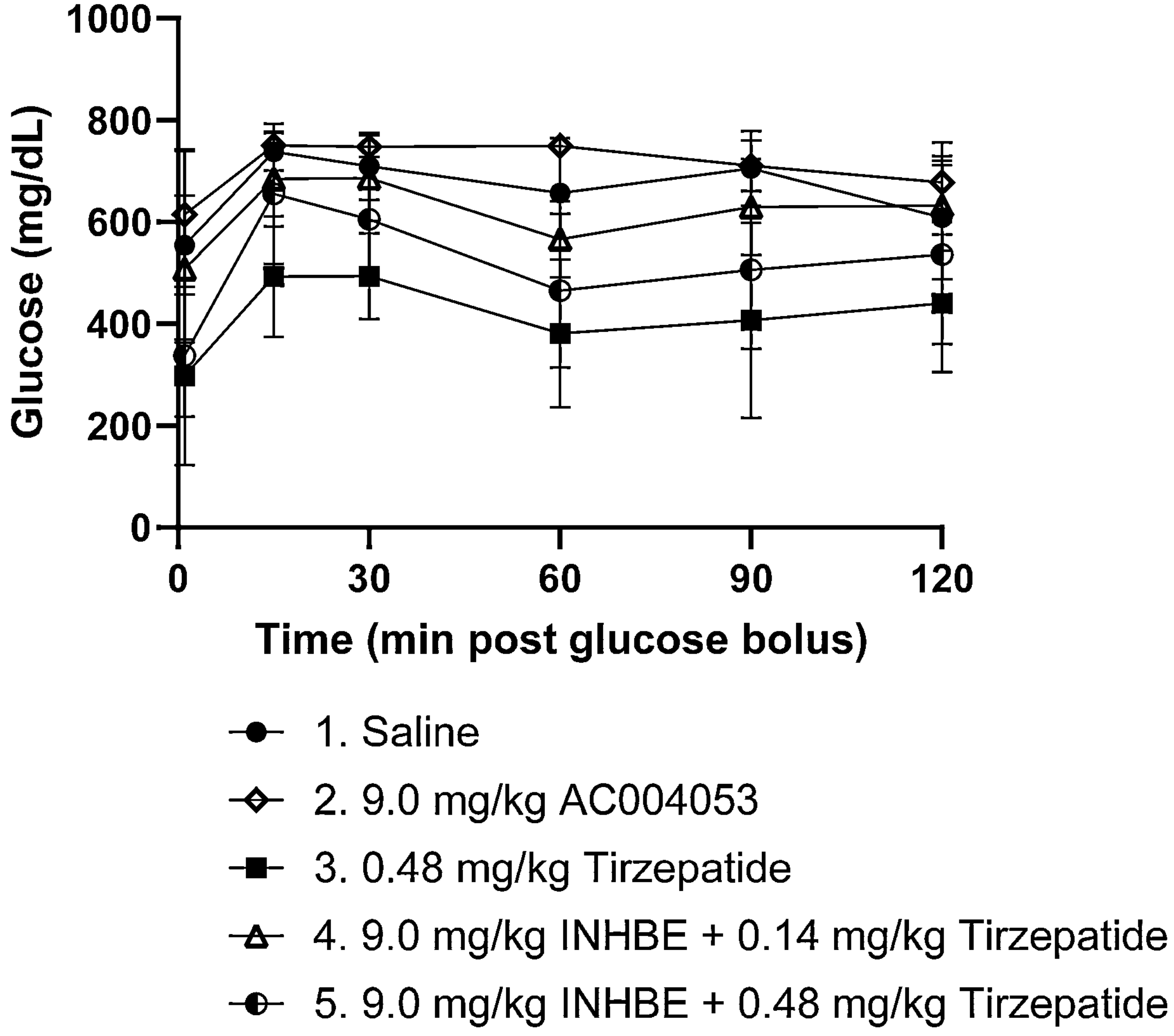
Figure 2H:
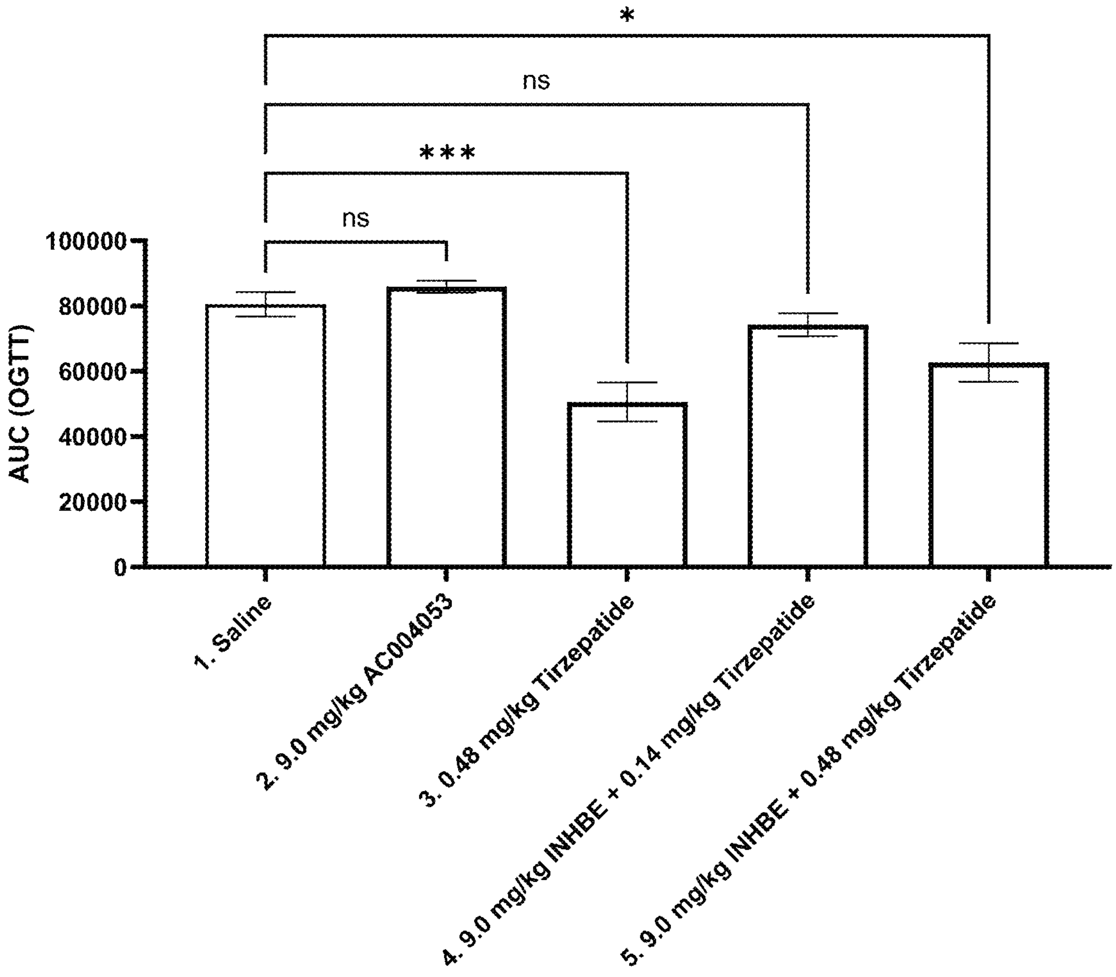

In db/db mice, weekly dosing of the INHBE RNAi agent maintained glucose homeostasis. Db/db mice dosed with AC004053 (Group 2, 9.0 mg/kg AC004053), in comparison with the saline control group, showed similar fasting glucose levels (FIG. 2F), similar glucose levels post glucose bolus (FIG. 2G), and similar glucose area under the curve (AUC) levels (FIG. 2H, as an oral glucose tolerance test). Significance level was calculated for glucose area under the curve and is denoted in FIG. 2H as **=p<0.0001, *=p<0.001, **=p<0.01, *=p<0.05, and ns=not significant.

These results demonstrate that knocking down INHBE has a significant pharmacological effect in reducing body weight in db/db mice.

Example 12. In Vivo Testing of INHBE RNAi Agents in Mice

The INHBE-GLuc-AAV model as described in Example 2, above, was used. On Day −21, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 1.0 mg/kg), via subcutaneous (SQ) injection, at 250 μL per 25 g body weight injection volume. The dosing regimen was in accordance with Table 26 below.

TABLE 26

Dosing Groups of Example 12.

| Group ID | RNAi Agent | Dose | Dosing Regimen | # Animals (n=) |
|---|---|---|---|---|
| 1 | Saline | N/A | Single SQ injection on day 1 | n = 4 |
| 2 | AC912692 | 1.0 mg/kg | Single SQ injection on day 1 | n = 4 |
| 3 | AC912695 | 1.0 mg/kg | Single SQ injection on day 1 | n = 4 |
| 4 | AC004047 | 1.0 mg/kg | Single SQ injection on day 1 | n = 4 |
| 5 | AC004007 | 1.0 mg/kg | Single SQ injection on day 1 | n = 4 |
| 6 | AC912707 | 1.0 mg/kg | Single SQ injection on day 1 | n = 4 |
| 7 | AC004185 | 1.0 mg/kg | Single SQ injection on day 1 | n = 4 |
| 8 | AC004285 | 1.0 mg/kg | Single SQ injection on day 1 | n = 4 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 27, with average GLuc reflecting the normalized average value of GLuc. Inhibition of INHBE expression by an INHBE RNAi agent results in concomitant inhibition of GLuc expression, which is measured.

TABLE 27

Average GLuc normalized to pre-treatment and saline control in INHBE-AAV-GLuc mice of Example 12.

| Group ID | Day 8 | | Day 15 | | Day 22 | |
|---|---|---|---|---|---|---|
| | Avg GLuc | Std Dev | Avg GLuc | Std Dev | Avg GLuc | Std Dev |
| 1. Saline | 1.000 | 0.085 | 1.000 | 0.126 | 1.000 | 0.117 |
| 2. 1.0 mg/kg AC912692 | 0.303 | 0.031 | 0.179 | 0.023 | 0.351 | 0.075 |
| 3. 1.0 mg/kg AC912695 | 0.237 | 0.036 | 0.158 | 0.012 | 0.317 | 0.058 |
| 4. 1.0 mg/kg AC004047 | 0.315 | 0.036 | 0.178 | 0.024 | 0.319 | 0.014 |
| 5. 1.0 mg/kg AC004007 | 0.258 | 0.028 | 0.233 | 0.103 | 0.347 | 0.072 |
| 6. 1.0 mg/kg AC912707 | 0.347 | 0.044 | 0.263 | 0.082 | 0.475 | 0.065 |
| 7. 1.0 mg/kg AC004185 | 0.243 | 0.058 | 0.177 | 0.017 | 0.344 | 0.047 |
| 8. 1.0 mg/kg AC004285 | 0.248 | 0.015 | 0.210 | 0.061 | 0.354 | 0.039 |

Groups 2-8 showed reduction in AAV-INHBE at Day 8, 15, and 22 compared to the saline control Group 1. More specifically, AC912695 achieved ~84% inhibition (0.158) on Day 15 at 1.0 mg/kg. The INHBE RNAi agents achieved reduction of AAV-INHBE out to at least Day 22. Notably, Group 3 (1.0 mg/kg AC912695) achieved ~68% inhibition (0.317) at Day 22.

Example 13. In Vivo Testing of INHBE RNAi Agents in Mice

The INHBE-GLuc-AAV model as described in Example 2, above, was used. On Day −21, four (n=4) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 1.0 mg/kg), via subcutaneous (SQ) injection, at 250 μL per 25 g body weight injection volume. The dosing regimen was in accordance with Table 28 below.

TABLE 28

Dosing Groups of Example 13.

| Group ID | RNAi Agent | Dose | Dosing Regimen | # Animals (n=) |
|---|---|---|---|---|
| 1 | Saline | N/A | Single SQ injection on day 1 | n = 4 |
| 2 | AC912189 | 1.0 mg/kg | Single SQ injection on day 1 | n = 4 |
| 3 | AC912688 | 1.0 mg/kg | Single SQ injection on day 1 | n = 4 |
| 4 | AC005048 | 1.0 mg/kg | Single SQ injection on day 1 | n = 4 |
| 5 | AC912706 | 1.0 mg/kg | Single SQ injection on day 1 | n = 4 |
| 6 | AC912712 | 1.0 mg/kg | Single SQ injection on day 1 | n = 4 |
| 7 | AC005049 | 1.0 mg/kg | Single SQ injection on day 1 | n = 4 |
| 8 | AC003824 | 1.0 mg/kg | Single SQ injection on day 1 | n = 4 |
| 9 | AC003825 | 1.0 mg/kg | Single SQ injection on day 1 | n = 4 |
| 10 | AC005050 | 1.0 mg/kg | Single SQ injection on day 1 | n = 4 |
| 11 | AC912694 | 1.0 mg/kg | Single SQ injection on day 1 | n = 4 |
| 12 | AC912698 | 1.0 mg/kg | Single SQ injection on day 1 | n = 4 |
| 13 | AC912699 | 1.0 mg/kg | Single SQ injection on day 1 | n = 4 |
| 14 | AC005051 | 1.0 mg/kg | Single SQ injection on day 1 | n = 4 |

TABLE 28-continued

| Dosing Groups of Example 13. | | | | |
|---|---|---|---|---|
| Group ID | RNAi Agent | Dose | Dosing Regimen | # Animals (n=) |
| 15 | AC005052 | 1.0 mg/kg | Single SQ injection on day 1 | n = 4 |
| 16 | AC005053 | 1.0 mg/kg | Single SQ injection on day 1 | n = 4 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 29, with average GLuc reflecting the normalized average value of GLuc. Inhibition of INHBE expression by an INHBE RNAi agent results in concomitant inhibition of GLuc expression, which is measured.

TABLE 29

Average GLuc normalized to pre-treatment and saline control in INHBE-AAV-GLuc mice of Example 13.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.210 | 1.000 | 0.223 | 1.000 | 0.222 |
| 2. 1.0 mg/kg AC912189 | 0.500 | 0.078 | 0.417 | 0.103 | 0.427 | 0.073 |
| 3. 1.0 mg/kg AC912688 | 0.457 | 0.230 | 0.333 | 0.130 | 0.381 | 0.178 |
| 4. 1.0 mg/kg AC005048 | 0.411 | 0.058 | 0.452 | 0.039 | 0.387 | 0.033 |
| 5. 1.0 mg/kg AC912706 | 0.595 | 0.159 | 0.527 | 0.123 | 0.488 | 0.161 |
| 6. 1.0 mg/kg AC912712 | 0.508 | 0.189 | 0.542 | 0.181 | 0.460 | 0.074 |
| 7. 1.0 mg/kg AC005049 | 0.456 | 0.067 | 0.446 | 0.076 | 0.395 | 0.027 |
| 8. 1.0 mg/kg AC003824 | 0.300 | 0.036 | 0.283 | 0.043 | 0.234 | 0.037 |
| 9. 1.0 mg/kg AC003825 | 0.320 | 0.047 | 0.318 | 0.037 | 0.278 | 0.029 |
| 10. 1.0 mg/kg AC005050 | 0.351 | 0.091 | 0.398 | 0.130 | 0.277 | 0.131 |
| 11. 1.0 mg/kg AC912694 | 0.484 | 0.192 | 0.528 | 0.244 | 0.457 | 0.150 |
| 12. 1.0 mg/kg AC912698 | 0.487 | 0.323 | 0.367 | 0.213 | 0.386 | 0.211 |
| 13. 1.0 mg/kg AC912699 | 0.434 | 0.055 | 0.440 | 0.073 | 0.469 | 0.022 |
| 14. 1.0 mg/kg AC005051 | 0.486 | 0.087 | 0.432 | 0.056 | 0.468 | 0.051 |
| 15. 1.0 mg/kg AC005052 | 0.512 | 0.095 | 0.593 | 0.086 | 0.513 | 0.129 |
| 16. 1.0 mg/kg AC005053 | 0.635 | 0.192 | 0.626 | 0.186 | 0.676 | 0.210 |

Groups 2-16 showed reduction in AAV-INHBE at Day 8, 15, and 22 compared to the saline control Group 1. More specifically, AC003824 achieved ~77% inhibition (0.234) on Day 22 at 1.0 mg/kg.

Example 14. In Vivo Testing of INHBE RNAi Agents in Mice

The INHBE-GLuc-AAV model as described in Example 2, above, was used. On Day −21, six (n=6) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 0.75 mg/kg), via subcutaneous (SQ) injection, at 250 μL per 25 g body weight injection volume. The dosing regimen was in accordance with Table 30 below.

TABLE 30

| Dosing Groups of Example 14. | | | | |
|---|---|---|---|---|
| Group ID | RNAi Agent | Dose | Dosing Regimen | # Animals (n=) |
| 1 | Saline | N/A | Single SQ injection on day 1 | n = 6 |
| 2 | AC004007 | 0.75 mg/kg | Single SQ injection on day 1 | n = 6 |
| 3 | AC005809 | 0.75 mg/kg | Single SQ injection on day 1 | n = 6 |
| 4 | AC005810 | 0.75 mg/kg | Single SQ injection on day 1 | n = 6 |
| 5 | AC005811 | 0.75 mg/kg | Single SQ injection on day 1 | n = 6 |
| 6 | AC005812 | 0.75 mg/kg | Single SQ injection on day 1 | n = 6 |
| 7 | AC005813 | 0.75 mg/kg | Single SQ injection on day 1 | n = 6 |
| 8 | AC005814 | 0.75 mg/kg | Single SQ injection on day 1 | n = 6 |
| 9 | AC004285 | 0.75 mg/kg | Single SQ injection on day 1 | n = 6 |
| 10 | AC005817 | 0.75 mg/kg | Single SQ injection on day 1 | n = 6 |
| 11 | AC005818 | 0.75 mg/kg | Single SQ injection on day 1 | n = 6 |
| 12 | AC005819 | 0.75 mg/kg | Single SQ injection on day 1 | n = 6 |
| 13 | AC005820 | 0.75 mg/kg | Single SQ injection on day 1 | n = 6 |
| 14 | AC005821 | 0.75 mg/kg | Single SQ injection on day 1 | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 31, with average GLuc reflecting the normalized average value of GLuc. Inhibition of INHBE expression by an INHBE RNAi agent results in concomitant inhibition of GLuc expression, which is measured.

TABLE 31

Average GLuc normalized to pre-treatment and saline control in INHBE-AAV-GLuc mice of Example 14.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.144 | 1.000 | 0.063 | 1.000 | 0.147 |
| 2. 0.75 mg/kg AC004007 | 0.528 | 0.042 | 0.410 | 0.020 | 0.465 | 0.077 |
| 3. 0.75 mg/kg AC005809 | 0.477 | 0.060 | 0.387 | 0.046 | 0.439 | 0.056 |
| 4. 0.75 mg/kg AC005810 | 0.868 | 0.139 | 0.692 | 0.087 | 0.724 | 0.127 |
| 5. 0.75 mg/kg AC005811 | 0.613 | 0.120 | 0.454 | 0.038 | 0.501 | 0.014 |
| 6. 0.75 mg/kg AC005812 | 0.428 | 0.091 | 0.313 | 0.062 | 0.283 | 0.070 |
| 7. 0.75 mg/kg AC005813 | 0.437 | 0.083 | 0.351 | 0.063 | 0.308 | 0.072 |
| 8. 0.75 mg/kg AC005814 | 0.729 | 0.104 | 0.577 | 0.075 | 0.560 | 0.066 |
| 9. 0.75 mg/kg AC004285 | 0.583 | 0.051 | 0.442 | 0.048 | 0.339 | 0.062 |
| 10. 0.75 mg/kg AC005817 | 0.709 | 0.172 | 0.583 | 0.064 | 0.578 | 0.098 |
| 11. 0.75 mg/kg AC005818 | 0.480 | 0.066 | 0.338 | 0.067 | 0.217 | 0.056 |
| 12. 0.75 mg/kg AC005819 | 0.493 | 0.047 | 0.362 | 0.077 | 0.301 | 0.057 |
| 13. 0.75 mg/kg AC005820 | 0.342 | 0.068 | 0.242 | 0.022 | 0.218 | 0.046 |
| 14. 0.75 mg/kg AC005821 | 0.476 | 0.072 | 0.386 | 0.078 | 0.380 | 0.112 |

Groups 2-15 showed reduction in AAV-INHBE at Day 8, 15, and 22 compared to the saline control Group 1, at low dose (0.75 mg/kg). More specifically, A 005818 achieved ~78% inhibition (0.217) on Day 22 at 0.75 mg/kg.

Example 15. In Vivo Testing of INHBE RNAi Agents in Mice

The INHBE-GLuc-AAV model as described in Example 2, above, was used. On Day −21, four (n=4) male C57bl/6 mice in each group were dosed with 5×10^12 GC/kg INHBE-Gluc AAV8, via intravenous (IV) injection. At Day 1, the mice were dosed with either saline or INHBE RNAi agents formulated in saline (at 1.0 mg/kg), via subcutaneous (SQ) injection, at 250 μL per 25 g body weight injection volume. The dosing regimen was in accordance with Table 32 below.

TABLE 32

Dosing Groups of Example 15.

| Group ID | RNAi Agent | Dose | Dosing Regimen | # Animals (n=) |
|---|---|---|---|---|
| 1 | Saline | N/A | Single SQ injection on day 1 | n = 4 |
| 2 | AC004285 | 1.0 mg/kg | Single SQ injection on day 1 | n = 4 |
| 3 | AC006192 | 1.0 mg/kg | Single SQ injection on day 1 | n = 4 |
| 4 | AC006193 | 1.0 mg/kg | Single SQ injection on day 1 | n = 4 |
| 5 | AC006210 | 1.0 mg/kg | Single SQ injection on day 1 | n = 4 |
| 6 | AC006194 | 1.0 mg/kg | Single SQ injection on day 1 | n = 4 |
| 7 | AC006195 | 1.0 mg/kg | Single SQ injection on day 1 | n = 4 |
| 8 | AC006211 | 1.0 mg/kg | Single SQ injection on day 1 | n = 4 |
| 9 | AC006212 | 1.0 mg/kg | Single SQ injection on day 1 | n = 4 |
| 10 | AC006196 | 1.0 mg/kg | Single SQ injection on day 1 | n = 4 |
| 11 | AC006197 | 1.0 mg/kg | Single SQ injection on day 1 | n = 4 |
| 12 | AC006198 | 1.0 mg/kg | Single SQ injection on day 1 | n = 4 |
| 13 | AC006199 | 1.0 mg/kg | Single SQ injection on day 1 | n = 4 |
| 14 | AC006200 | 1.0 mg/kg | Single SQ injection on day 1 | n = 4 |
| 15 | AC006201 | 1.0 mg/kg | Single SQ injection on day 1 | n = 4 |
| 16 | AC006202 | 1.0 mg/kg | Single SQ injection on day 1 | n = 4 |
| 17 | AC006203 | 1.0 mg/kg | Single SQ injection on day 1 | n = 4 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 33, with average GLuc reflecting the normalized average value of GLuc. Inhibition of INHBE expression by an INHBE RNAi agent results in concomitant inhibition of GLuc expression, which is measured.

TABLE 33

Average GLuc normalized to pre-treatment and saline control in INHBE-AAV-GLuc mice of Example 15.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.192 | 1.000 | 0.194 | 1.000 | 0.062 |
| 2. 1.0 mg/kg AC004285 | 0.282 | 0.077 | 0.342 | 0.033 | 0.412 | 0.061 |
| 3. 1.0 mg/kg AC006192 | 0.450 | 0.027 | 0.551 | 0.047 | 0.601 | 0.081 |
| 4. 1.0 mg/kg AC006193 | 0.457 | 0.053 | 0.471 | 0.029 | 0.540 | 0.034 |
| 5. 1.0 mg/kg AC006210 | 0.994 | 0.125 | 1.111 | 0.145 | 1.169 | 0.138 |
| 6. 1.0 mg/kg AC006194 | 0.384 | 0.031 | 0.440 | 0.059 | 0.782 | 0.086 |
| 7. 1.0 mg/kg AC006195 | 0.646 | 0.089 | 0.649 | 0.089 | 0.914 | 0.140 |
| 8. 1.0 mg/kg AC006211 | 0.797 | 0.084 | 0.954 | 0.052 | 1.068 | 0.022 |
| 9. 1.0 mg/kg AC006212 | 0.614 | 0.070 | 0.750 | 0.056 | 0.854 | 0.082 |
| 10. 1.0 mg/kg AC006196 | 0.544 | 0.099 | 0.656 | 0.079 | 0.730 | 0.093 |
| 11. 1.0 mg/kg AC006197 | 0.342 | 0.061 | 0.390 | 0.074 | 0.469 | 0.079 |
| 12. 1.0 mg/kg AC006198 | 0.740 | 0.066 | 1.056 | 0.180 | 1.037 | 0.093 |
| 13. 1.0 mg/kg AC006199 | 0.333 | 0.057 | 0.405 | 0.044 | 0.535 | 0.027 |
| 14. 1.0 mg/kg AC006200 | 0.477 | 0.063 | 0.505 | 0.063 | 0.671 | 0.120 |
| 15. 1.0 mg/kg AC006201 | 0.385 | 0.070 | 0.456 | 0.071 | 0.604 | 0.051 |
| 16. 1.0 mg/kg AC006202 | 0.638 | 0.074 | 0.702 | 0.142 | 0.821 | 0.050 |
| 17. 1.0 mg/kg AC006203 | 0.387 | 0.095 | 0.446 | 0.072 | 0.582 | 0.035 |

Groups 2-17 showed varying levels of reduction in AAV-INHBE at Day 8, 15, and 22 compared to the saline control Group 1. Group 5 (AC006210) showed almost no AAV-INHBE inhibition at all time points. Groups 8 and 12 showed almost no AAV-INHBE inhibition at Day 15 and Day 22. Of the tested RNAi agents, Group 2 (AC004285) achieved the most potent AAV-INHBE inhibition, of ~72% inhibition (0.282) at Day 8, at 1.0 mg/kg. Some of the INHBE RNAi agents achieved reduction of AAV-INHBE out to at least Day 22. Notably, Group 2 (1.0 mg/kg AC004285) achieved ~59% inhibition (0.412) at Day 22.

Example 16. In Vivo Testing of INHBE RNAi Agents in Mice

The INHBE-GLuc-AAV model as described in Example 2, above, was used. On Day −19, six (n=6) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 0.5 mg/kg or 1.0 mg/kg), via subcutaneous (SQ) injection, at 250 μL per 25 g body weight injection volume. The dosing regimen was in accordance with Table 34 below.

TABLE 34

Dosing Groups of Example 16.

| Group ID | RNAi Agent | Dose | Dosing Regimen | # Animals (n=) |
|---|---|---|---|---|
| 1 | Saline | N/A | Single SQ injection on day 1 | n = 6 |
| 2 | AC004285 | 0.5 mg/kg | Single SQ injection on day 1 | n = 6 |
| 3 | AC004285 | 1.0 mg/kg | Single SQ injection on day 1 | n = 6 |
| 4 | AC005818 | 0.5 mg/kg | Single SQ injection on day 1 | n = 6 |
| 5 | AC005818 | 1.0 mg/kg | Single SQ injection on day 1 | n = 6 |
| 6 | AC005819 | 0.5 mg/kg | Single SQ injection on day 1 | n = 6 |
| 7 | AC005819 | 1.0 mg/kg | Single SQ injection on day 1 | n = 6 |
| 8 | AC006559 | 0.5 mg/kg | Single SQ injection on day 1 | n = 6 |
| 9 | AC006559 | 1.0 mg/kg | Single SQ injection on day 1 | n = 6 |
| 10 | AC006560 | 0.5 mg/kg | Single SQ injection on day 1 | n = 6 |
| 11 | AC006560 | 1.0 mg/kg | Single SQ injection on day 1 | n = 6 |
| 12 | AC006561 | 0.5 mg/kg | Single SQ injection on day 1 | n = 6 |
| 13 | AC006561 | 1.0 mg/kg | Single SQ injection on day 1 | n = 6 |
| 14 | AC006562 | 0.5 mg/kg | Single SQ injection on day 1 | n = 6 |
| 15 | AC006562 | 1.0 mg/kg | Single SQ injection on day 1 | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 28 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 35, with average GLuc reflecting the normalized average value of GLuc. Inhibition of INHBE expression by an INHBE RNAi agent results in concomitant inhibition of GLuc expression, which is measured.

TABLE 35

Average GLuc normalized to pre-treatment and saline control in INHBE-AAV-GLuc mice of Example 16.

| | Day 8 | | Day 15 | | Day 28 | |
|---|---|---|---|---|---|---|
| Group ID | Avg GLuc | Std Dev | Avg GLuc | Std Dev | Avg GLuc | Std Dev |
| 1. Saline | 1.000 | 0.248 | 1.000 | 0.197 | 1.000 | 0.216 |
| 2. 0.5 mg/kg AC004285 | 0.363 | 0.072 | 0.407 | 0.080 | 0.486 | 0.097 |
| 3. 1.0 mg/kg AC004285 | 0.250 | 0.066 | 0.293 | 0.056 | 0.382 | 0.082 |
| 4. 0.5 mg/kg AC005818 | 0.423 | 0.081 | 0.496 | 0.098 | 0.544 | 0.073 |
| 5. 1.0 mg/kg AC005818 | 0.289 | 0.055 | 0.314 | 0.066 | 0.382 | 0.094 |
| 6. 0.5 mg/kg AC005819 | 0.410 | 0.088 | 0.409 | 0.043 | 0.534 | 0.111 |
| 7. 1.0 mg/kg AC005819 | 0.257 | 0.131 | 0.260 | 0.135 | 0.328 | 0.182 |
| 8. 0.5 mg/kg AC006559 | 0.355 | 0.065 | 0.386 | 0.078 | 0.352 | 0.068 |
| 9. 1.0 mg/kg AC006559 | 0.245 | 0.046 | 0.212 | 0.042 | 0.219 | 0.038 |
| 10. 0.5 mg/kg AC006560 | 0.447 | 0.082 | 0.535 | 0.138 | 0.530 | 0.102 |
| 11. 1.0 mg/kg AC006560 | 0.486 | 0.140 | 0.544 | 0.184 | 0.547 | 0.118 |
| 12. 0.5 mg/kg AC006561 | 0.417 | 0.066 | 0.431 | 0.115 | 0.480 | 0.094 |
| 13. 1.0 mg/kg AC006561 | 0.246 | 0.057 | 0.221 | 0.067 | 0.252 | 0.052 |
| 14. 0.5 mg/kg AC006562 | 0.573 | 0.112 | 0.654 | 0.136 | 0.651 | 0.177 |
| 15. 1.0 mg/kg AC006562 | 0.436 | 0.082 | 0.417 | 0.096 | 0.540 | 0.098 |

Groups 2-15 showed varying levels of reduction in AAV-INHBE at Day 8, 15, and 22 compared to the saline control Group 1. Of the tested RNAi agents, Group 9 (AC006559) achieved the most potent AAV-INHBE inhibition, of ~79% inhibition (0.212) at Day 15, at 1.0 mg/kg. On Day 8, a dose response was observed for Groups 2&3, 4&5, 6&7, 8&9, 12&13, and 14&15. On Day 15, a dose response was observed for Groups 2&3, 4&5, 6&7, 8&9, 12&13, and 14&15. On Day 28, a dose response was observed for Groups 2&3, 4&5, 6&7, 8&9, 12&13, and 14&15. The INHBE RNAi agents achieved reduction of AAV-INHBE out to at least Day 28. Notably, Group 9 (1.0 mg/kg AC006559) achieved ~78% inhibition (0.219) at Day 28.

Example 17. In Vivo Testing of INHBE RNAi Agents in Mice

The INHBE-GLuc-AAV model as described in Example 2, above, was used. On Day −21, six (n=6) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 0.75 mg/kg), via subcutaneous (SQ) injection, at 250 μL per 25 g body weight injection volume. The dosing regimen was in accordance with Table 36 below.

TABLE 36

Dosing Groups of Example 17.

| Group ID | RNAi Agent | Dose | Dosing Regimen | # Animals (n=) |
|---|---|---|---|---|
| 1 | Saline | N/A | Single SQ injection on day 1 | n = 6 |
| 2 | AC004007 | 0.75 mg/kg | Single SQ injection on day 1 | n = 6 |
| 3 | AC006197 | 0.75 mg/kg | Single SQ injection on day 1 | n = 6 |
| 4 | AC007393 | 0.75 mg/kg | Single SQ injection on day 1 | n = 6 |

TABLE 36-continued

| Dosing Groups of Example 17. | | | | |
|---|---|---|---|---|
| Group ID | RNAi Agent | Dose | Dosing Regimen | # Animals (n=) |
| 5 | AC007394 | 0.75 mg/kg | Single SQ injection on day 1 | n = 6 |
| 6 | AC007395 | 0.75 mg/kg | Single SQ injection on day 1 | n = 6 |
| 7 | AC007396 | 0.75 mg/kg | Single SQ injection on day 1 | n = 6 |
| 8 | AC007397 | 0.75 mg/kg | Single SQ injection on day 1 | n = 6 |
| 9 | AC007398 | 0.75 mg/kg | Single SQ injection on day 1 | n = 6 |
| 10 | AC007399 | 0.75 mg/kg | Single SQ injection on day 1 | n = 6 |
| 11 | AC007400 | 0.75 mg/kg | Single SQ injection on day 1 | n = 6 |
| 12 | AC007401 | 0.75 mg/kg | Single SQ injection on day 1 | n = 6 |
| 13 | AC007402 | 0.75 mg/kg | Single SQ injection on day 1 | n = 6 |
| 14 | AC007403 | 0.75 mg/kg | Single SQ injection on day 1 | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 37, with average GLuc reflecting the normalized average value of GLuc. Inhibition of INHBE expression by an INHBE RNAi agent results in concomitant inhibition of GLuc expression, which is measured.

TABLE 37

Average GLuc normalized to pre-treatment and saline control in INHBE-AAV-GLuc mice of Example 17.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.242 | 1.000 | 0.273 | 1.000 | 0.331 |
| 2. 0.75 mg/kg AC004007 | 0.325 | 0.066 | 0.283 | 0.041 | 0.270 | 0.050 |
| 3. 0.75 mg/kg AC006197 | 0.480 | 0.142 | 0.447 | 0.118 | 0.420 | 0.098 |
| 4. 0.75 mg/kg AC007393 | 0.467 | 0.074 | 0.415 | 0.085 | 0.427 | 0.050 |
| 5. 0.75 mg/kg AC007394 | 0.336 | 0.063 | 0.272 | 0.045 | 0.342 | 0.111 |
| 6. 0.75 mg/kg AC007395 | 0.438 | 0.107 | 0.434 | 0.114 | 0.569 | 0.138 |
| 7. 0.75 mg/kg AC007396 | 0.682 | 0.025 | 0.423 | 0.017 | 0.583 | 0.008 |
| 8. 0.75 mg/kg AC007397 | 0.660 | 0.279 | 0.502 | 0.247 | 0.635 | 0.204 |
| 9. 0.75 mg/kg AC007398 | 0.333 | 0.069 | 0.246 | 0.059 | 0.266 | 0.045 |
| 10. 0.75 mg/kg AC007399 | 0.456 | 0.050 | 0.413 | 0.067 | 0.577 | 0.067 |
| 11. 0.75 mg/kg AC007400 | 0.283 | 0.061 | 0.193 | 0.052 | 0.289 | 0.112 |
| 12. 0.75 mg/kg AC007401 | 0.495 | 0.108 | 0.357 | 0.125 | 0.412 | 0.066 |
| 13. 0.75 mg/kg AC007402 | 0.605 | 0.140 | 0.381 | 0.104 | 0.496 | 0.160 |
| 14. 0.75 mg/kg AC007403 | 0.613 | 0.198 | 0.368 | 0.119 | 0.441 | 0.121 |

Groups 2-14 showed varying levels of reduction in AAV-INHBE at Day 8, 15, and 22 compared to the saline control Group 1. Of the tested RNAi agents, Group 11 (AC007400) achieved the most potent AAV-INHBE inhibition, of ~81% (0.193) at Day 15, at 0.75 mg/kg. The INHBE RNAi agents achieved reduction of AAV-INHBE out to at least Day 22. Notably, Group 9 (0.75 mg/kg A007398) achieved g73 inhibition (0.266) at Day 22.

Example 18. In Vivo Testing of INHBE RNAi Agents in Mice

The INHBE-GLuc-AAV model as described in Example 2, above, was used. On Day −21, six (n=6) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 0.5 mg/kg or 1.0 mg/kg), via subcutaneous (SQ) injection, at 250 μL per 25 g body weight injection volume. The dosing regimen was in accordance with Table 38 below.

TABLE 38

| Dosing Groups of Example 18. | | | | |
|---|---|---|---|---|
| Group ID | RNAi Agent | Dose | Dosing Regimen | # Animals (n=) |
| 1 | PBS | N/A | Single SQ injection on day 1 | n = 6 |
| 2 | AC004007 | 0.5 mg/kg | Single SQ injection on day 1 | n = 6 |
| 3 | AC004007 | 1.0 mg/kg | Single SQ injection on day 1 | n = 6 |
| 4 | AC007394 | 0.5 mg/kg | Single SQ injection on day 1 | n = 6 |
| 5 | AC007394 | 1.0 mg/kg | Single SQ injection on day 1 | n = 6 |
| 6 | AC007400 | 0.5 mg/kg | Single SQ injection on day 1 | n = 6 |
| 7 | AC007400 | 1.0 mg/kg | Single SQ injection on day 1 | n = 6 |
| 8 | AC007398 | 0.5 mg/kg | Single SQ injection on day 1 | n = 6 |
| 9 | AC007398 | 1.0 mg/kg | Single SQ injection on day 1 | n = 6 |
| 10 | AC008278 | 0.5 mg/kg | Single SQ injection on day 1 | n = 6 |
| 11 | AC008279 | 0.5 mg/kg | Single SQ injection on day 1 | n = 6 |
| 12 | AC008274 | 0.5 mg/kg | Single SQ injection on day 1 | n = 6 |
| 13 | AC008275 | 0.5 mg/kg | Single SQ injection on day 1 | n = 6 |
| 14 | AC008276 | 0.5 mg/kg | Single SQ injection on day 1 | n = 6 |
| 15 | AC008277 | 0.5 mg/kg | Single SQ injection on day 1 | n = 6 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 39, with average GLuc reflecting the normalized average value of GLuc. Inhibition of INHBE expression by an INHBE RNAi agent results in concomitant inhibition of GLuc expression, which is measured.

TABLE 39

Average GLuc normalized to pre-treatment and saline control in INHBE-AAV-GLuc mice of Example 18.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. PBS | 1.000 | 0.253 | 1.000 | 0.196 | 1.000 | 0.379 |
| 2. 0.5 mg/kg AC004007 | 0.531 | 0.053 | 0.548 | 0.052 | 0.495 | 0.107 |
| 3. 1.0 mg/kg AC004007 | 0.275 | 0.070 | 0.321 | 0.103 | 0.336 | 0.118 |
| 4. 0.5 mg/kg AC007394 | 0.625 | 0.103 | 0.678 | 0.121 | 0.610 | 0.192 |
| 5. 1.0 mg/kg AC007394 | 0.357 | 0.071 | 0.447 | 0.054 | 0.449 | 0.135 |
| 6. 0.5 mg/kg AC007400 | 0.314 | 0.072 | 0.431 | 0.114 | 0.305 | 0.084 |
| 7. 1.0 mg/kg AC007400 | 0.216 | 0.043 | 0.282 | 0.085 | 0.288 | 0.049 |
| 8. 0.5 mg/kg AC007398 | 0.351 | 0.068 | 0.424 | 0.123 | 0.348 | 0.042 |
| 9. 1.0 mg/kg AC007398 | 0.243 | 0.080 | 0.218 | 0.046 | 0.174 | 0.065 |
| 10. 0.5 mg/kg AC008278 | 0.383 | 0.052 | 0.448 | 0.128 | 0.339 | 0.071 |
| 11. 0.5 mg/kg AC008279 | 0.361 | 0.103 | 0.415 | 0.120 | 0.323 | 0.103 |
| 12. 0.5 mg/kg AC008274 | 0.519 | 0.141 | 0.665 | 0.153 | 0.480 | 0.098 |
| 13. 0.5 mg/kg AC008275 | 0.623 | 0.077 | 0.644 | 0.126 | 0.505 | 0.118 |
| 14. 0.5 mg/kg AC008276 | 0.491 | 0.117 | 0.511 | 0.105 | 0.338 | 0.150 |
| 15. 0.5 mg/kg AC008277 | 0.490 | 0.144 | 0.450 | 0.116 | 0.343 | 0.175 |

Groups 2-15 showed varying levels of reduction in AAV-INHBE at Day 8, 15, and 22 compared to the saline control Group 1. Of the tested RNAi agents, Group 9 (AC007398) achieved the most potent AAV-INHBE inhibition, of ~83% (0.174) at Day 22, at 1.0 mg/kg. The INHBE RNAi agents achieved reduction of AAV-INHBE out to at least Day 22. A dose response was observed for AC004007 (at Day 8, 15, and 22), AC007394 (at Day 8, 15, and 22), AC007400 (at Day 8, 15, and 22), and AC007398 (at Day 8, 15, and 22).

Example 19. In Vivo Testing of INHBE RNAi Agents in Mice

The INHBE-GLuc-AAV model as described in Example 2, above, was used. On Day −21, five (n=5) or six (n=6) male C57bl/6 mice in each group were dosed with ~5×10^12 GC/kg INHBE-Gluc AAV8, via intravenous (IV) injection. At Day 1, the mice were dosed with either saline or INHBE RNAi agents formulated in saline (at 0.5 mg/kg or 1.0 mg/kg), via subcutaneous (SQ) injection, at 250 μL per 25 g body weight injection volume. The dosing regimen was in accordance with Table 40 below.

TABLE 40

Dosing Groups of Example 19.

| Group ID | RNAi Agent | Dose | Dosing Regimen | # Animals (n=) |
|---|---|---|---|---|
| 1 | Saline | — | Single SQ injection on day 1 | n = 5 |
| 2 | AC004007 | 0.5 mpk | Single SQ injection on day 1 | n = 6 |
| 3 | AC004007 | 1.0 mpk | Single SQ injection on day 1 | n = 6 |
| 4 | AC007400 | 0.5 mpk | Single SQ injection on day 1 | n = 6 |
| 5 | AC007400 | 1.0 mpk | Single SQ injection on day 1 | n = 6 |
| 6 | AC912692 | 0.5 mpk | Single SQ injection on day 1 | n = 6 |
| 7 | AC912692 | 1.0 mpk | Single SQ injection on day 1 | n = 6 |
| 8 | AC008890 | 0.5 mpk | Single SQ injection on day 1 | n = 6 |
| 9 | AC008890 | 1.0 mpk | Single SQ injection on day 1 | n = 6 |
| 10 | AC005820 | 0.5 mpk | Single SQ injection on day 1 | n = 6 |
| 11 | AC005820 | 1.0 mpk | Single SQ injection on day 1 | n = 6 |
| 12 | AC008888 | 0.5 mpk | Single SQ injection on day 1 | n = 5 |
| 13 | AC008888 | 1.0 mpk | Single SQ injection on day 1 | n = 5 |
| 14 | AC008889 | 0.5 mpk | Single SQ injection on day 1 | n = 5 |
| 15 | AC008889 | 1.0 mpk | Single SQ injection on day 1 | n = 5 |
| 16 | AC008891 | 0.5 mpk | Single SQ injection on day 1 | n = 5 |
| 17 | AC008891 | 1.0 mpk | Single SQ injection on day 1 | n = 5 |
| 18 | AC008892 | 0.5 mpk | Single SQ injection on day 1 | n = 5 |
| 19 | AC008892 | 1.0 mpk | Single SQ injection on day 1 | n = 5 |

The injections were performed between the skin and muscle (i.e. subcutaneous injections) into the loose skin over the neck and shoulder area. Animals were weighed prior to dosing, and the dosing volume was individually adjusted based on the animal body weight. On Day −7, 1, 8, 15, and 22 post injection, serum was collected.

Each of the INHBE RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the INHBE RNAi agents, including (NAG37)s ligand).

GLuc levels were determined pursuant to the procedure set forth in Example 2, above. Data from the experiment are shown in the following Table 41, with average GLuc reflecting the normalized average value of GLuc. Inhibition of INHBE expression by an INHBE RNAi agent results in concomitant inhibition of GLuc expression, which is measured.

TABLE 41

Average GLuc normalized to pre-treatment and saline control in INHBE-AAV-GLuc mice of Example 19.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 1. Saline | 1.000 | 0.211 | 1.000 | 0.188 | 1.000 | 0.198 |
| 2. 0.5 mg/kg AC004007 | 0.463 | 0.055 | 0.369 | 0.035 | 0.453 | 0.088 |
| 3. 1.0 mg/kg AC004007 | 0.397 | 0.068 | 0.332 | 0.050 | 0.441 | 0.131 |
| 4. 0.5 mg/kg AC007400 | 0.488 | 0.105 | 0.486 | 0.064 | 0.533 | 0.048 |
| 5. 1.0 mg/kg AC007400 | 0.321 | 0.060 | 0.344 | 0.054 | 0.388 | 0.045 |
| 6. 0.5 mg/kg AC912692 | 0.660 | 0.207 | 0.629 | 0.205 | 0.708 | 0.164 |

TABLE 41-continued

Average GLuc normalized to pre-treatment and saline control in INHBE-AAV-GLuc mice of Example 19.

| | Day 8 | | Day 15 | | Day 22 | |
|---|---|---|---|---|---|---|
| Group ID | Avg GLuc | Std Dev | Avg GLuc | Std Dev | Avg GLuc | Std Dev |
| 7. 1.0 mg/kg AC912692 | 0.400 | 0.070 | 0.344 | 0.065 | 0.398 | 0.065 |
| 8. 0.5 mg/kg AC008890 | 0.473 | 0.137 | 0.375 | 0.118 | 0.396 | 0.153 |
| 9. 1.0 mg/kg AC008890 | 0.305 | 0.158 | 0.296 | 0.116 | 0.334 | 0.148 |
| 10. 0.5 mg/kg AC005820 | 0.541 | 0.140 | 0.500 | 0.166 | 0.525 | 0.098 |
| 11. 1.0 mg/kg AC005820 | 0.176 | 0.043 | 0.142 | 0.031 | 0.173 | 0.058 |
| 12. 0.5 mg/kg AC008888 | 0.351 | 0.065 | 0.277 | 0.067 | 0.359 | 0.072 |
| 13. 1.0 mg/kg AC008888 | 0.243 | 0.074 | 0.207 | 0.078 | 0.286 | 0.131 |
| 14. 0.5 mg/kg AC008889 | 0.472 | 0.030 | 0.441 | 0.028 | 0.451 | 0.063 |
| 15. 1.0 mg/kg AC008889 | 0.473 | 0.408 | 0.355 | 0.283 | 0.425 | 0.381 |
| 16. 0.5 mg/kg AC008891 | 0.939 | 0.154 | 0.796 | 0.083 | 0.881 | 0.083 |
| 17. 1.0 mg/kg AC008891 | 0.708 | 0.338 | 0.497 | 0.091 | 0.648 | 0.143 |
| 18. 0.5 mg/kg AC008892 | 0.523 | 0.077 | 0.514 | 0.141 | 0.605 | 0.108 |
| 19. 1.0 mg/kg AC008892 | 0.538 | 0.115 | 0.548 | 0.189 | 0.714 | 0.201 |

Groups 2-19 showed varying levels of reduction in AAV-INHBE at Day 8, 15, and 22 compared to the saline control Group 1; Group 16 showed negligible reduction at all time points. Of the tested RNAi agents, Group 11 (AC005820) achieved the most potent AAV-INHBE inhibition, of ~86% (0.142) at Day 15, at 1.0 mg/kg. The INHBE RNAi agents achieved reduction of AAV-INHBE out to at least Day 22. A dose response was observed for AC004007 (at Day 8, 15, and 22), AC007400 (at Day 8, 15, and 22), AC912692 (at Day 8, 15, and 22), AC008890 (at Day 8, 15, and 22), AC005820 (at Day 8, 15, and 22), AC008888 (at Day 8, 15, and 22), AC008889 (at Day 15 and 22), and AC008891 (at Day 8, 15, and 22).

Example 20. In Vivo Testing of INHBE RNAi Agents in Cynomolgus Monkeys

INHBE RNAi agents were tested in Cynomolgus monkeys for inhibition of NHBE. On Day 1 and Day 29, four (n=4) Cynomolgus monkeys for each test group were dosed with INHBE RNAi agents formulated in saline (at 1.5 mg/kg or 4.5 mg/kg), via subcutaneous (SQ) injection with syringe and needle in the mid-scapular region, at 0.3 mL/kg dose volume. The dosing regimen was in accordance with Table 42 below.

TABLE 42

Dosing for Cynomolgus animals of Example 20.

| Group | Dose (RNAi Agent) | Dosing Route | # of Animals (n=) |
|---|---|---|---|
| 1 | Saline | Day 1 & 29 SQ Injection | n = 4 (1M, 3F) |
| 2 | 1.5 mg/kg AC004285 | Day 1 & 29 SQ Injection | n = 4 (4F) |
| 3 | 4.5 mg/kg AC004285 | Day 1 & 29 SQ Injection | n = 4 (2M, 2F) |
| 4 | 4.5 mg/kg AC007400 | Day 1 & 29 SQ Injection | n = 4 (1M, 3F) |

The test animals were of Cynomolgus macaques, weight at 3 to 7 kg or greater, and a mix of male and female as noted in Table 42.

Before each SQ injection, the test animals were first sedated. Sedation was accomplished using Ketamine HCl (10 mg/kg), administered as an intramuscular (IM) injection (none was injected into the quadriceps). Individual doses of INHBE RNAi agents were calculated based on the body weights recorded on each day of dosing.

For each animal, liver biopsy samples (approximately 40 mg each (30 to 60 mg; ±10%)) were collected for exploratory gene knockdown analysis.

Serum blood was collected on Day −14, Day −7, Day 1, Day 15, Day 29, Day 52, and Day 85, prior to liver biopsy sample collections or dose administration (when applicable), and from any animals found in moribund condition or sacrificed at an unscheduled interval. The collection site was the femoral vein, with a saphenous vein as an alternative collection site.

The liver biopsies and serum collected from the test animals were used for analysis for INHBE expression and additional biological parameters. Liver biopsies were collected on Day −14, Day 15, Day 29 (prior to dosing), Day 52, and Day 85.

Liver biopsies were collected as a sedated procedure. Animals were fasted overnight (at least 12 hours but less than 18 hours) prior to each liver biopsy collection. For each animal, collected liver biopsy samples were of approximately 40 mg each (30 to 60 mg; ±10%).

The collected liver biopsies were analyzed for INHBE expression and additional biological parameters. Liver cINHBE mRNA expression levels were quantified via qPCR, using cARL1 as endogenous control gene, normalized to Day-7 (pre-dose). The qPCR INHBE expression data is shown in the following Table 43.

TABLE 43

Liver INHBE expression of Cynomolgus monkeys of Example 20.

| | Day −14 | | | Day 15 | | |
|---|---|---|---|---|---|---|
| Group ID | Rel. Exp. | Error Low | Error High | Rel. Exp. | Error Low | Error High |
| 1. Saline | 1.000 | 0.204 | 0.256 | 0.953 | 0.216 | 0.280 |
| 2. 1.5 mg/kg AC004285 | 1.000 | 0.236 | 0.309 | 0.749 | 0.140 | 0.172 |
| 3. 4.5 mg/kg AC004285 | 1.000 | 0.244 | 0.323 | 0.412 | 0.122 | 0.174 |
| 4. 4.5 mg/kg AC007400 | 1.000 | 0.383 | 0.619 | 0.509 | 0.083 | 0.100 |

| | Day 29 | | | Day 52 | | |
|---|---|---|---|---|---|---|
| Group ID | Rel. Exp. | Error Low | Error High | Rel. Exp. | Error Low | Error High |
| 1. Saline | 1.240 | 0.194 | 0.230 | 0.715 | 0.211 | 0.300 |
| 2. 1.5 mg/kg AC004285 | 0.854 | 0.371 | 0.656 | 0.535 | 0.078 | 0.091 |
| 3. 4.5 mg/kg AC004285 | 0.483 | 0.121 | 0.162 | 0.253 | 0.067 | 0.091 |
| 4. 4.5 mg/kg AC007400 | 0.651 | 0.354 | 0.775 | 0.550 | 0.162 | 0.230 |

| | Day 85 | | |
|---|---|---|---|
| Group ID | Rel. Exp. | Error Low | Error High |
| 1. Saline | 0.918 | 0.305 | 0.456 |
| 2. 1.5 mg/kg AC004285 | 0.795 | 0.242 | 0.348 |
| 3. 4.5 mg/kg AC004285 | 0.411 | 0.069 | 0.083 |
| 4. 4.5 mg/kg AC007400 | 1.035 | 0.374 | 0.586 |

*Group 3 (4.5 mg/kg AC004285) only included 3 of 4 cynos, as one cyno was deemed to be a non-responder and excluded from the data analysis.

INHBE RNAi agents achieved knockdown of INHBE transcripts for a duration of at least 85 days, with two subcutaneous SQ injections at 1.5 mg/kg or 4.5 mg/kg on Day 1 and Day 29. Groups 2-4 showed varying levels reduction in INHBE at Day 15, 29, 57, and 85 compared to the pre-dose Day −14. More notably, two doses of 4.5 mg/kg AC004285 achieved ~59% inhibition (0.411) on Day 85; two doses of 4.5 mg/kg AC004285 achieved ~75% inhibition (0.253) at Day 52 (at nadir).

Serum INHBE was quantified via LC-MS/MS assay, with ALVLELAK as analyte peptide sequence. The serum INHBE protein expression is normalized to Day −14 (pre-dose) levels of each respective test group. The serum INHBE protein levels are shown in the following Table 44.

TABLE 44

Serum INHBE expression of Cynomolgus monkeys of Example 20.

| Group ID | Day −14 Rel. INHBE | Day −14 Std. Dev. | Day 15 Rel. INHBE | Day 15 Std. Dev. | Day 29 Rel. INHBE | Day 29 Std. Dev. |
|---|---|---|---|---|---|---|
| 1. Saline | 1.000 | 0.009 | 0.781 | 0.108 | 0.588 | 0.169 |
| 2. 1.5 mg/kg AC004285 | 1.000 | 0.018 | 0.607 | 0.173 | 0.764 | 0.478 |
| 3. 4.5 mg/kg AC004285 | 1.000 | 0.016 | 0.355 | 0.196 | 0.225 | 0.093 |
| 4. 4.5 mg/kg AC007400 | 1.000 | 0.026 | 0.495 | 0.069 | 0.570 | 0.175 |

| Group ID | Day 52 Rel. INHBE | Day 52 Std. Dev. | Day 85 Rel. INHBE | Day 85 Std. Dev. |
|---|---|---|---|---|
| 1. Saline | 0.649 | 0.267 | 0.631 | 0.106 |
| 2. 1.5 mg/kg AC004285 | 0.707 | 0.345 | 0.791 | 0.479 |
| 3. 4.5 mg/kg AC004285 | 0.252 | 0.116 | 0.326 | 0.086 |
| 4. 4.5 mg/kg AC007400 | 0.483 | 0.120 | 0.731 | 0.327 |

*Group 3 (4.5 mg/kg AC004285) only included 3 of 4 cynos, as one cyno was deemed to be a non-responder and excluded from the data analysis.

INHBE RNAi agents achieved knockdown of INHBE in serum with two subcutaneous SQ injections at 1.5 mg/kg or 4.5 mg/kg on Day 1 and Day 29, for a duration of at least 85 days. Groups 2-4 showed varying levels reduction in INHBE at Day 15, 29, 57, and 85 compared to the pre-dose Day −14. More notably, two doses of 4.5 mg/kg AC004285 achieved ~67% inhibition (0.326) on Day 85; two doses of 4.5 mg/kg AC004285 achieved ~77% inhibition (0.225) at Day 29 (at nadir).

Example 21. Phase 1/2A Clinical Study of INHBE RNAi Agents in Adult Volunteers with Obesity with and without Type 2 Diabetes Mellitus INHBE RNAi agents are proposed to be tested in human clinical trials.

Figure 3:
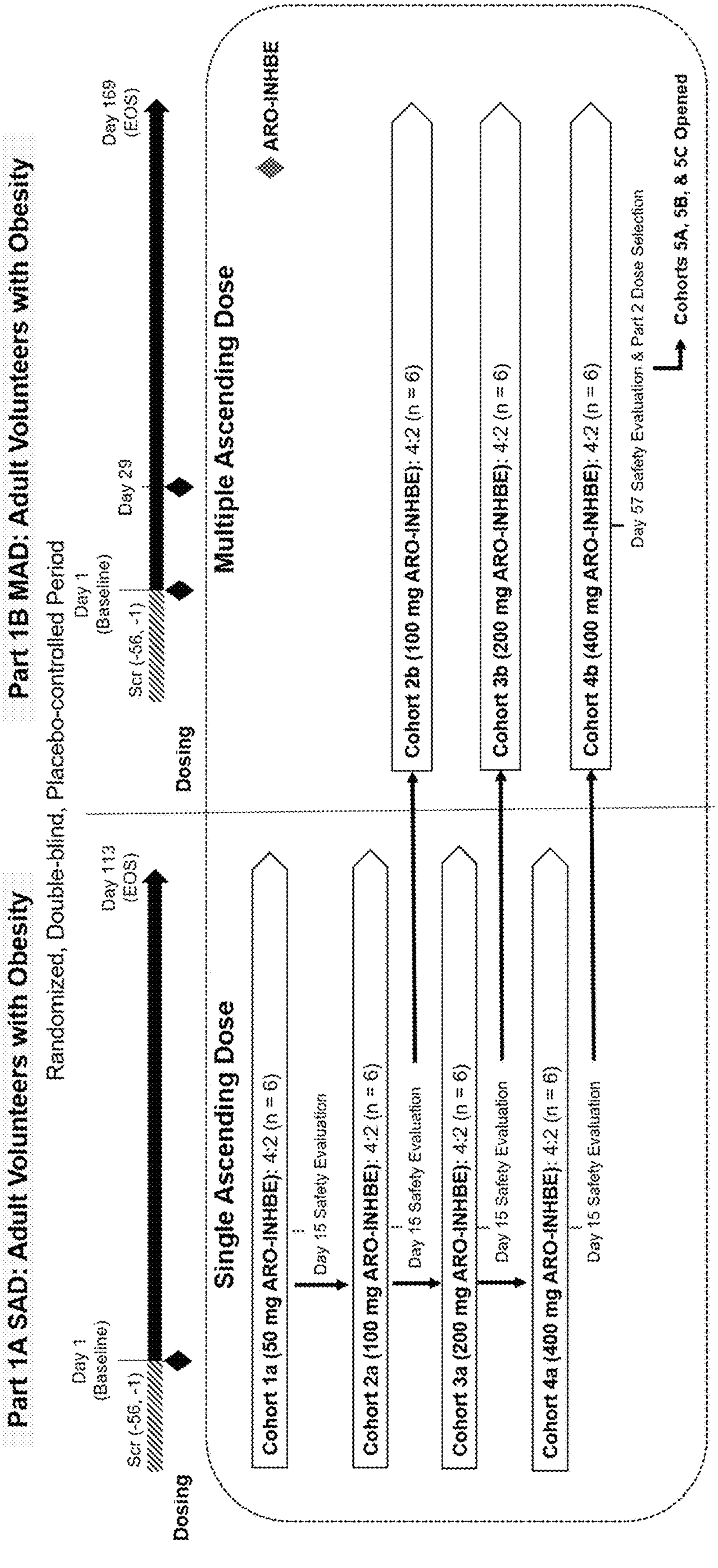

Proposed Study Design: A Phase 1/2a dose-escalating study to evaluate the safety, tolerability, PK, and PD of single and multiple doses of an INHBE RNAi agent in adult volunteers with obesity (in Part 1) and the safety, tolerability, and PD of repeat doses of an INHBE RNAi agent in adult volunteers with obesity with and without type 2 diabetes mellitus receiving tirzepatide (in Part 2). The duration of study participation will be approximately 24-32 weeks, from the beginning of the 56-day Screening period to the end of study (Day 113 or 169 for Part 1, and Day 169 for Part 2). The Study Schema for the proposed study are set forth in FIG. 3 (Part 1) and FIG. 4 (Part 2).

Summary of Proposed Part 1

Proposed Part 1A of the study will evaluate single ascending doses (SAD) of INHBE RNAi agent in volunteers with obesity in Cohorts 1a, 2a, 3a, and 4a, to enroll 6 subjects in each cohort to be randomized with 4 subjects administered the INHBE RNAi agent and 2 subjects administered placebo (PBO). Proposed Part 1B will evaluate multiple ascending doses (MAD) of INHBE RNAi agent in adult volunteers in Cohorts 2b, 3b, and 4b, to also enroll 6 subjects in each cohort to be randomized with 4 subjects administered the INHBE RNAi agent and 2 subjects administered placebo (PBO). Eligible subjects for Part 1 of the proposed study will include adult non-pregnant, non-lactating subjects, between 18-65 years old, with obesity (BMI 30-50 kg/m2), without evidence of Type 2 Diabetes at Screening (confirmed by laboratory assessment), stable weight at the time of Screening (no increase or decrease in weight >5% in the preceding 3 months), and at least one self-reported unsuccessful attempt at weight loss with lifestyle modification.

Summary of Proposed Part 2

Figure 4:
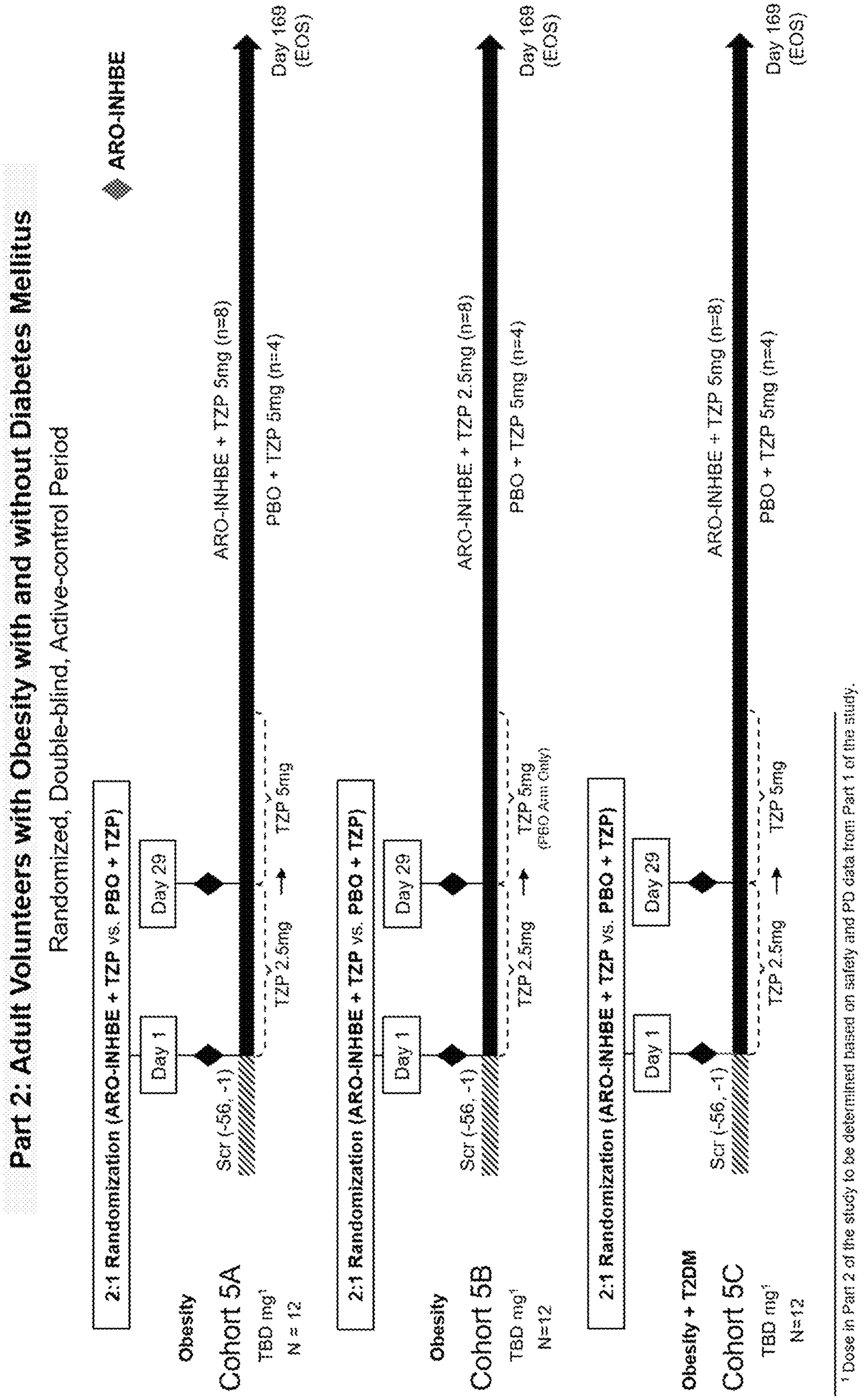

Proposed Part 2 of the study will evaluate multiple doses of INHBE RNAi agent in subjects with obesity with and without Type 2 Diabetes Mellitus also receiving tirzepatide. Each of Cohorts 5A and 5B of proposed Part 2 of the study will enroll and randomize 12 subjects with obesity without Type 2 Diabetes Mellitus, with 8 subjects administered the INHBE RNAi agent and 4 subjects administered placebo (PBO). Cohort 5C will enroll and randomize 12 subjects with obesity with Type 2 Diabetes Mellitus, with 8 subjects administered the INHBE RNAi agent and 4 subjects administered placebo (PBO). As shown in FIG. 4, eligible subjects enrolled in Cohort 5A, Cohort 5B, and Cohort 5C will be randomized (2:1) to combined therapy with tirzepatide and an INHBE RNAi agent (intervention arm) or tirzepatide monotherapy (control/PBO arm). Tirzepatide in Cohort 5A and Cohort 5C will be initiated on Day 1 at a dose of 2.5 mg subcutaneous weekly for four weeks, then escalated to a dose of 5 mg subcutaneous weekly. Tirzepatide in Cohort 5B will be initiated in all subjects on Day 1 at a dose of 2.5 mg subcutaneous weekly for four weeks; subjects assigned to the control arm will then have dose escalation to 5 mg subcutaneous weekly, while subjects assigned to the intervention group will continue tirzepatide at 2.5 mg subcutaneous weekly. INHBE RNAi agent (or matched volume of PBO) will be administered as subcutaneous injections on Day 1 and Day 29, at a dose level to be determined based on safety and pharmacodynamic data from Part 1 of the study. Subjects in Cohorts 5A, 5B, and 5C will be followed until Day 169 (end of study).

Eligible subjects for Part 2 of the study, subject to certain additional exclusion criteria, will include adult non-pregnant, non-lactating subjects, between 18-65 years old, with obesity (BMI 30-50 kg/m2), either with [Cohort 5C] or without [Cohorts 5A, 5B] Type 2 Diabetes Miletus (T2DM), stable weight at the time of screening (no increase or decrease in weight >5% in the preceding 3 months), and at least one self-reported unsuccessful attempt at weight loss with lifestyle modification.

The primary objective of the study is to assess the safety and tolerability of single and multiple subcutaneous (SC) doses of ARO-INHBE in adult volunteers with obesity with and without Type 2 Diabetes Mellitus. In addition, the study will be aimed at assessing the pharmacokinetics (PK) of single and multiple SC doses of ARO-INHBE in adult volunteers with obesity and the pharmacodynamics (PD) of single and multiple doses of ARO-INHBE in adult volunteers with obesity with and without Type 2 Diabetes Mellitus The primary, secondary, and exploratory endpoints of the study are:

- Incidence, frequency, and severity of treatment-emergent adverse events (TEAEs).
- Plasma PK and urinary excretion of ARO-INHBE [Part 1 Cohorts].
- Change and percent change from baseline in serum Activin E protein at scheduled visits.
- Change and percent change in body weight from baseline at scheduled visits.
- Percent of subjects achieving at least 5% weight loss from baseline at end of study (EOS).
- Change and percent change in waist/hip circumference from baseline at scheduled visits.
- Change and percent change in total fat and lean tissue volume (measured neck-to-knee), abdominal subcutaneous and visceral adipose tissue volume, thigh muscle volume and fat content, by magnetic resonance imaging (MRI), from baseline at scheduled visits.
- Change and percent change in liver steatosis by Magnetic Resonance Imaging Proton Density Fat Fraction (MRI-PDFF) from baseline at scheduled visits.
- Change and percent change in lipid parameters (triglycerides, LDL cholesterol, HDL cholesterol, non-HDL cholesterol, total cholesterol, FFA/NEFAs, ApoB, ApoB-48, ApoB-100) from baseline at scheduled visits.
- Change and percent change in metabolic biomarkers (BHB, glycerol, adiponectin, leptin, adiponectin-leptin ratio)
- Change and percent change in measures of glucose homeostasis including-.beta cell function and insulin sensitivity (HgbA1c, fasting glucose, insulin, glucagon, C-peptide, proinsulin, HOMA2-% B, HOMA2-IR, and Adipo-IR) from baseline at scheduled visits.
- Change in SBP and DBP from baseline at scheduled visits.
- Plasma and urine metabolite identification for ARO-INHBE [Part 1 Cohorts Only]
- Plasma PK of ARO-INHBE [Part 2 Cohorts Only]
- Incidence and titers of anti-drug antibodies (ADA) to ARO-INHBE (if criteria met, see Section 12.1.6.8)

Other Embodiments

It is to be understood that while the invention has been described in conjunction with the detailed description thereof, the foregoing description is intended to illustrate and not limit the scope of the invention, which is defined by the scope of the appended embodiments. Other embodiments, advantages, and modifications are within the scope of the following claims.

---

SEQUENCE LISTING (757 sequences)

SEQ ID NO: 1 - RNA, 2460 nt, Homo sapiens
  source 1..2460: mol_type = mRNA
agtagccagacatgagctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaatggaatgtgtgcttgta

SEQ ID NO: 2 - RNA, 19 nt, synthetic construct
  source 1..19: mol_type = other RNA
cagtcgtcccagaataact

SEQ ID NO: 3 - RNA, 19 nt, synthetic construct
  source 1..19: mol_type = other RNA
gtcacagactccacttcag

SEQ ID NO: 4 - RNA, 19 nt, synthetic construct
  source 1..19: mol_type = other RNA
ccacttcagcctacagctc

SEQ ID NO: 5 - RNA, 19 nt, synthetic construct
  source 1..19: mol_type = other RNA
ggcactctttgcttgagga

SEQ ID NO: 6 - RNA, 19 nt, synthetic construct
  source 1..19: mol_type = other RNA
actctttgcttgaggatct

SEQ ID NO: 7 - RNA, 19 nt, synthetic construct
  source 1..19: mol_type = other RNA
tgcttgaggatcttccgat

SEQ ID NO: 8 - RNA, 19 nt, synthetic construct
  source 1..19: mol_type = other RNA
caccacatcaccaacctgg

SEQ ID NO: 9 - RNA, 19 nt, synthetic construct
  source 1..19: mol_type = other RNA
tcctgaaactgcaactaga

SEQ ID NO: 10 - RNA, 19 nt, synthetic construct
  source 1..19: mol_type = other RNA
cctgaaactgcaactagac

SEQ ID NO: 11 - RNA, 19 nt, synthetic construct
  source 1..19: mol_type = other RNA
ttcctagagcttaagatcc

SEQ ID NO: 12 - RNA, 19 nt, synthetic construct
  source 1..19: mol_type = other RNA
ctagagcttaagatccgag

SEQ ID NO: 13 - RNA, 19 nt, synthetic construct
  source 1..19: mol_type = other RNA
ggtaccagctgaattactg

SEQ ID NO: 14 - RNA, 19 nt, synthetic construct
  source 1..19: mol_type = other RNA
taccagctgaattactgca

SEQ ID NO: 15 - RNA, 19 nt, synthetic construct
  source 1..19: mol_type = other RNA
gctgcctctttccattctg

SEQ ID NO: 16 - RNA, 19 nt, synthetic construct
  source 1..19: mol_type = other RNA
ctgcctctttccattctgc

SEQ ID NO: 17 - RNA, 19 nt, synthetic construct
  source 1..19: mol_type = other RNA
tcctctacctggatcataa

SEQ ID NO: 18 - RNA, 19 nt, synthetic construct
  source 1..19: mol_type = other RNA
ataatggcaatgtggtcaa

SEQ ID NO: 19 - RNA, 19 nt, synthetic construct
  source 1..19: mol_type = other RNA
aatggcaatgtggtcaaga

SEQ ID NO: 20 - RNA, 19 nt, synthetic construct
  source 1..19: mol_type = other RNA
agtgaagagaccaagatga

SEQ ID NO: 21 - RNA, 19 nt, synthetic construct
  source 1..19: mol_type = other RNA
actggaggcatcagattcc

SEQ ID NO: 22 - RNA, 19 nt, synthetic construct
  source 1..19: mol_type = other RNA
ccacctggcaatatgactc

SEQ ID NO: 23 - RNA, 19 nt, synthetic construct
  source 1..19: mol_type = other RNA
tggcaatatgactcacttg

SEQ ID NO: 24 - RNA, 19 nt, synthetic construct
  source 1..19: mol_type = other RNA
actcacttgacccctatgg

SEQ ID NO: 25 - RNA, 19 nt, synthetic construct
  source 1..19: mol_type = other RNA
acccaaatgggcactttct

SEQ ID NO: 26 - RNA, 19 nt, synthetic construct
  source 1..19: mol_type = other RNA
caaatgggcactttcttgt

SEQ ID NO: 27 - RNA, 19 nt, synthetic construct
  source 1..19: mol_type = other RNA
aatgggcactttcttgtct

SEQ ID NO: 28 - RNA, 19 nt, synthetic construct
  source 1..19: mol_type = other RNA
caggttggctgatgtgttg

SEQ ID NO: 29 - RNA, 19 nt, synthetic construct
  source 1..19: mol_type = other RNA
ggaggaagcagatagatgg

SEQ ID NO: 30 - RNA, 19 nt, synthetic construct
  source 1..19: mol_type = other RNA
gcttgaagcagggtaagca

SEQ ID NO: 31 - RNA, 19 nt, synthetic construct
  source 1..19: mol_type = other RNA
cttgaagcagggtaagcag

SEQ ID NO: 32 - RNA, 19 nt, synthetic construct
  source 1..19: mol_type = other RNA
actaagcctaagaagttcc

SEQ ID NO: 33 - RNA, 19 nt, synthetic construct
  source 1..19: mol_type = other RNA
ctgggagacaagcatttat

SEQ ID NO: 34 - RNA, 19 nt, synthetic construct
  source 1..19: mol_type = other RNA
gagacaagcatttatactt

SEQ ID NO: 35 - RNA, 19 nt, synthetic construct
  source 1..19: mol_type = other RNA
agacaagcatttatacttt

SEQ ID NO: 36 - RNA, 19 nt, synthetic construct
  source 1..19: mol_type = other RNA
cctggcttatactttctta

SEQ ID NO: 37 - RNA, 19 nt, synthetic construct
  source 1..19: mol_type = other RNA
ctggcttatactttcttaa

SEQ ID NO: 38 - RNA, 19 nt, synthetic construct
  source 1..19: mol_type = other RNA
ggcttatactttcttaata

SEQ ID NO: 39 - RNA, 19 nt, synthetic construct
  source 1..19: mol_type = other RNA
agttattctgggacgactg

SEQ ID NO: 40 - RNA, 19 nt, synthetic construct
  source 1..19: mol_type = other RNA
tgttattctgggacgactg

SEQ ID NO: 41 - RNA, 19 nt, synthetic construct
  source 1..19: mol_type = other RNA
ngttattctgggacgactg

SEQ ID NO: 42 - RNA, 19 nt, synthetic construct
  source 1..19: mol_type = other RNA
ngttattctgggacgactn

SEQ ID NO: 43 - RNA, 19 nt, synthetic construct
  source 1..19: mol_type = other RNA
ctgaagtggagtctgtgac

SEQ ID NO: 44 - RNA, 19 nt, synthetic construct
  source 1..19: mol_type = other RNA
ttgaagtggagtctgtgac

SEQ ID NO: 45 - RNA, 19 nt, synthetic construct
  source 1..19: mol_type = other RNA
atgaagtggagtctgtgac

SEQ ID NO: 46 - RNA, 19 nt, synthetic construct
  source 1..19: mol_type = other RNA
ntgaagtggagtctgtgac

SEQ ID NO: 47 - RNA, 19 nt, synthetic construct
  source 1..19: mol_type = other RNA
ntgaagtggagtctgtgan

SEQ ID NO: 48 - RNA, 19 nt, synthetic construct
  source 1..19: mol_type = other RNA
gagctgtaggctgaagtgg

SEQ ID NO: 49 - RNA, 19 nt, synthetic construct
  source 1..19: mol_type = other RNA
tagctgtaggctgaagtgg

SEQ ID NO: 50 - RNA, 19 nt, synthetic construct
  source 1..19: mol_type = other RNA
aagctgtaggctgaagtgg

SEQ ID NO: 51 - RNA, 19 nt, synthetic construct
  source 1..19: mol_type = other RNA
nagctgtaggctgaagtgg

SEQ ID NO: 52 - RNA, 19 nt, synthetic construct
  source 1..19: mol_type = other RNA
nagctgtaggctgaagtgn

SEQ ID NO: 53 - RNA, 19 nt, synthetic construct
  source 1..19: mol_type = other RNA
tcctcaagcaaagagtgcc

SEQ ID NO: 54 - RNA, 19 nt, synthetic construct
  source 1..19: mol_type = other RNA
acctcaagcaaagagtgcc

SEQ ID NO: 55 - RNA, 19 nt, synthetic construct
  source 1..19: mol_type = other RNA
ncctcaagcaaagagtgcc

SEQ ID NO: 56 - RNA, 19 nt, synthetic construct
  source 1..19: mol_type = other RNA
ncctcaagcaaagagtgcn

SEQ ID NO: 57 - RNA, 19 nt, synthetic construct
  source 1..19: mol_type = other RNA
agatcctcaagcaaagagt

SEQ ID NO: 58 - RNA, 19 nt, synthetic construct
  source 1..19: mol_type = other RNA
tgatcctcaagcaaagagt

SEQ ID NO: 59 - RNA, 19 nt, synthetic construct
  source 1..19: mol_type = other RNA
ngatcctcaagcaaagagt

SEQ ID NO: 60 - RNA, 19 nt, synthetic construct
  source 1..19: mol_type = other RNA
ngatcctcaagcaaagagn

SEQ ID NO: 61 - RNA, 19 nt, synthetic construct
  source 1..19: mol_type = other RNA
atcggaagatcctcaagca

SEQ ID NO: 62 - RNA, 19 nt, synthetic construct
  source 1..19: mol_type = other RNA
ttcggaagatcctcaagca

SEQ ID NO: 63 - RNA, 19 nt, synthetic construct
  source 1..19: mol_type = other RNA
ntcggaagatcctcaagca

SEQ ID NO: 64 - RNA, 19 nt, synthetic construct
  source 1..19: mol_type = other RNA
ntcggaagatcctcaagcn

SEQ ID NO: 65 - RNA, 19 nt, synthetic construct
  source 1..19: mol_type = other RNA
ccaggttggtgatgtggtg

SEQ ID NO: 66 - RNA, 19 nt, synthetic construct
  source 1..19: mol_type = other RNA
tcaggttggtgatgtggtg

SEQ ID NO: 67 - RNA, 19 nt, synthetic construct
  source 1..19: mol_type = other RNA
acaggttggtgatgtggtg

SEQ ID NO: 68 - RNA, 19 nt, synthetic construct
  source 1..19: mol_type = other RNA
ncaggttggtgatgtggtg

SEQ ID NO: 69 - RNA, 19 nt, synthetic construct
  source 1..19: mol_type = other RNA
ncaggttggtgatgtggtn

SEQ ID NO: 70 - RNA, 19 nt, synthetic construct
  source 1..19: mol_type = other RNA
tctagttgcagtttcagga

SEQ ID NO: 71 - RNA, 19 nt, synthetic construct
  source 1..19: mol_type = other RNA
actagttgcagtttcagga

SEQ ID NO: 72 - RNA, 19 nt, synthetic construct
  source 1..19: mol_type = other RNA
nctagttgcagtttcagga

SEQ ID NO: 73 - RNA, 19 nt, synthetic construct
  source 1..19: mol_type = other RNA
nctagttgcagtttcaggn

SEQ ID NO: 74 - RNA, 19 nt, synthetic construct
  source 1..19: mol_type = other RNA
gtctagttgcagtttcagg

SEQ ID NO: 75 - RNA, 19 nt, synthetic construct
  source 1..19: mol_type = other RNA
ttctagttgcagtttcagg

SEQ ID NO: 76 - RNA, 19 nt, synthetic construct
  source 1..19: mol_type = other RNA
atctagttgcagtttcagg

SEQ ID NO: 77 - RNA, 19 nt, synthetic construct
  source 1..19: mol_type = other RNA
ntctagttgcagtttcagg

SEQ ID NO: 78 - RNA, 19 nt, synthetic construct
  source 1..19: mol_type = other RNA
ntctagttgcagtttcagn

SEQ ID NO: 79 - RNA, 19 nt, synthetic construct
  source 1..19: mol_type = other RNA
ggatcttaagctctaggaa

SEQ ID NO: 80 - RNA, 19 nt, synthetic construct
  source 1..19: mol_type = other RNA
agatcttaagctctaggaa

SEQ ID NO: 81 - RNA, 19 nt, synthetic construct
  source 1..19: mol_type = other RNA
tgatcttaagctctaggaa

SEQ ID NO: 82 - RNA, 19 nt, synthetic construct
  source 1..19: mol_type = other RNA
ngatcttaagctctaggaa

SEQ ID NO: 83 - RNA, 19 nt, synthetic construct
  source 1..19: mol_type = other RNA
ngatcttaagctctaggan

SEQ ID NO: 84 - RNA, 19 nt, synthetic construct
  source 1..19: mol_type = other RNA
ctcggatcttaagctctag

SEQ ID NO: 85 - RNA, 19 nt, synthetic construct
  source 1..19: mol_type = other RNA
ttcggatcttaagctctag

SEQ ID NO: 86 - RNA, 19 nt, synthetic construct
  source 1..19: mol_type = other RNA
atcggatcttaagctctag

SEQ ID NO: 87 - RNA, 19 nt, synthetic construct
  source 1..19: mol_type = other RNA
ntcggatcttaagctctag

SEQ ID NO: 88 - RNA, 19 nt, synthetic construct
  source 1..19: mol_type = other RNA
ntcggatcttaagctctan

SEQ ID NO: 89 - RNA, 19 nt, synthetic construct
  source 1..19: mol_type = other RNA
cagtaattcagctggtacc

SEQ ID NO: 90 - RNA, 19 nt, synthetic construct
  source 1..19: mol_type = other RNA
aagtaattcagctggtacc

SEQ ID NO: 91 - RNA, 19 nt, synthetic construct
  source 1..19: mol_type = other RNA
tagtaattcagctggtacc

SEQ ID NO: 92 - RNA, 19 nt, synthetic construct
  source 1..19: mol_type = other RNA
nagtaattcagctggtacc

SEQ ID NO: 93 - RNA, 19 nt, synthetic construct
  source 1..19: mol_type = other RNA
nagtaattcagctggtacn

SEQ ID NO: 94 - RNA, 19 nt, synthetic construct
  source 1..19: mol_type = other RNA
tgcagtaattcagctggta

SEQ ID NO: 95 - RNA, 19 nt, synthetic construct
  source 1..19: mol_type = other RNA
agcagtaattcagctggta

SEQ ID NO: 96 - RNA, 19 nt, synthetic construct
  source 1..19: mol_type = other RNA
ngcagtaattcagctggta

SEQ ID NO: 97 - RNA, 19 nt, synthetic construct
  source 1..19: mol_type = other RNA
ngcagtaattcagctggtn

SEQ ID NO: 98 - RNA, 19 nt, synthetic construct
  source 1..19: mol_type = other RNA
cagaatggaaagaggcagc

SEQ ID NO: 99 - RNA, 19 nt, synthetic construct
  source 1..19: mol_type = other RNA
aagaatggaaagaggcagc

SEQ ID NO: 100 - RNA, 19 nt, synthetic construct
  source 1..19: mol_type = other RNA
tagaatggaaagaggcagc

SEQ ID NO: 101 - RNA, 19 nt, synthetic construct
  source 1..19: mol_type = other RNA
nagaatggaaagaggcagc

SEQ ID NO: 102 - RNA, 19 nt, synthetic construct
  source 1..19: mol_type = other RNA
nagaatggaaagaggcagn

SEQ ID NO: 103 - RNA, 19 nt, synthetic construct
  source 1..19: mol_type = other RNA
gcagaatggaaagaggcag

SEQ ID NO: 104 - RNA, 19 nt, synthetic construct
  source 1..19: mol_type = other RNA
tcagaatggaaagaggcag

SEQ ID NO: 105 - RNA, 19 nt, synthetic construct
  source 1..19: mol_type = other RNA
acagaatggaaagaggcag

SEQ ID NO: 106 - RNA, 19 nt, synthetic construct
  source 1..19: mol_type = other RNA
ncagaatggaaagaggcag

SEQ ID NO: 107 - RNA, 19 nt, synthetic construct
  source 1..19: mol_type = other RNA
ncagaatggaaagaggcan

SEQ ID NO: 108 - RNA, 19 nt, synthetic construct
  source 1..19: mol_type = other RNA
ttatgatccaggtagagga

SEQ ID NO: 109 - RNA, 19 nt, synthetic construct
  source 1..19: mol_type = other RNA
atatgatccaggtagagga

SEQ ID NO: 110 - RNA, 19 nt, synthetic construct
  source 1..19: mol_type = other RNA
ntatgatccaggtagagga

SEQ ID NO: 111 - RNA, 19 nt, synthetic construct
  source 1..19: mol_type = other RNA
ntatgatccaggtagaggn

SEQ ID NO: 112 - RNA, 19 nt, synthetic construct
  source 1..19: mol_type = other RNA
ttgaccacattgccattat

SEQ ID NO: 113 - RNA, 19 nt, synthetic construct
  source 1..19: mol_type = other RNA
atgaccacattgccattat

SEQ ID NO: 114 - RNA, 19 nt, synthetic construct
  source 1..19: mol_type = other RNA
ntgaccacattgccattat

SEQ ID NO: 115 - RNA, 19 nt, synthetic construct
  source 1..19: mol_type = other RNA
ntgaccacattgccattan

SEQ ID NO: 116 - RNA, 19 nt, synthetic construct
  source 1..19: mol_type = other RNA
tcttgaccacattgccatt

SEQ ID NO: 117 - RNA, 19 nt, synthetic construct
  source 1..19: mol_type = other RNA
acttgaccacattgccatt

SEQ ID NO: 118 - RNA, 19 nt, synthetic construct
  source 1..19: mol_type = other RNA
ncttgaccacattgccatt

SEQ ID NO: 119 - RNA, 19 nt, synthetic construct
  source 1..19: mol_type = other RNA
ncttgaccacattgccatn

SEQ ID NO: 120 - RNA, 19 nt, synthetic construct
  source 1..19: mol_type = other RNA
tcatcttggtctcttcact

SEQ ID NO: 121 - RNA, 19 nt, synthetic construct
  source 1..19: mol_type = other RNA
acatcttggtctcttcact

SEQ ID NO: 122 - RNA, 19 nt, synthetic construct
  source 1..19: mol_type = other RNA
ncatcttggtctcttcact

SEQ ID NO: 123 - RNA, 19 nt, synthetic construct
  source 1..19: mol_type = other RNA
ncatcttggtctcttcacn

SEQ ID NO: 124 - RNA, 19 nt, synthetic construct
  source 1..19: mol_type = other RNA
ggaatctgatgcctccagt

SEQ ID NO: 125 - RNA, 19 nt, synthetic construct
  source 1..19: mol_type = other RNA
agaatctgatgcctccagt

SEQ ID NO: 126 - RNA, 19 nt, synthetic construct
  source 1..19: mol_type = other RNA
tgaatctgatgcctccagt

SEQ ID NO: 127 - RNA, 19 nt, synthetic construct
  source 1..19: mol_type = other RNA
ngaatctgatgcctccagt

SEQ ID NO: 128 - RNA, 19 nt, synthetic construct
  source 1..19: mol_type = other RNA
ngaatctgatgcctccagn

SEQ ID NO: 129 - RNA, 19 nt, synthetic construct
  source 1..19: mol_type = other RNA
gagtcatattgccaggtgg

SEQ ID NO: 130 - RNA, 19 nt, synthetic construct
  source 1..19: mol_type = other RNA
aagtcatattgccaggtgg

SEQ ID NO: 131 - RNA, 19 nt, synthetic construct
  source 1..19: mol_type = other RNA
tagtcatattgccaggtgg

SEQ ID NO: 132 - RNA, 19 nt, synthetic construct
  source 1..19: mol_type = other RNA
nagtcatattgccaggtgg

SEQ ID NO: 133 - RNA, 19 nt, synthetic construct
  source 1..19: mol_type = other RNA
nagtcatattgccaggtgn

SEQ ID NO: 134 - RNA, 19 nt, synthetic construct
  source 1..19: mol_type = other RNA
caagtgagtcatattgcca

SEQ ID NO: 135 - RNA, 19 nt, synthetic construct
  source 1..19: mol_type = other RNA
taagtgagtcatattgcca

SEQ ID NO: 136 - RNA, 19 nt, synthetic construct
  source 1..19: mol_type = other RNA
aaagtgagtcatattgcca

SEQ ID NO: 137 - RNA, 19 nt, synthetic construct
  source 1..19: mol_type = other RNA
naagtgagtcatattgcca

SEQ ID NO: 138 - RNA, 19 nt, synthetic construct
  source 1..19: mol_type = other RNA
naagtgagtcatattgccn

SEQ ID NO: 139 - RNA, 19 nt, synthetic construct
  source 1..19: mol_type = other RNA
ccataggggtcaagtgagt

SEQ ID NO: 140 - RNA, 19 nt, synthetic construct
  source 1..19: mol_type = other RNA
acataggggtcaagtgagt

SEQ ID NO: 141 - RNA, 19 nt, synthetic construct
  source 1..19: mol_type = other RNA
tcataggggtcaagtgagt

SEQ ID NO: 142 - RNA, 19 nt, synthetic construct
  source 1..19: mol_type = other RNA
ncataggggtcaagtgagt

SEQ ID NO: 143 - RNA, 19 nt, synthetic construct
  source 1..19: mol_type = other RNA
ncataggggtcaagtgagn

SEQ ID NO: 144 - RNA, 19 nt, synthetic construct
  source 1..19: mol_type = other RNA
agaaagtgcccatttgggt

SEQ ID NO: 145 - RNA, 19 nt, synthetic construct
  source 1..19: mol_type = other RNA
tgaaagtgcccatttgggt

SEQ ID NO: 146 - RNA, 19 nt, synthetic construct
  source 1..19: mol_type = other RNA
ngaaagtgcccatttgggt

SEQ ID NO: 147 - RNA, 19 nt, synthetic construct
  source 1..19: mol_type = other RNA
ngaaagtgcccatttgggn

SEQ ID NO: 148 - RNA, 19 nt, synthetic construct
  source 1..19: mol_type = other RNA
acaagaaagtgcccatttg

SEQ ID NO: 149 - RNA, 19 nt, synthetic construct
  source 1..19: mol_type = other RNA
tcaagaaagtgcccatttg

SEQ ID NO: 150 - RNA, 19 nt, synthetic construct
  source 1..19: mol_type = other RNA
ncaagaaagtgcccatttg

SEQ ID NO: 151 - RNA, 19 nt, synthetic construct
  source 1..19: mol_type = other RNA
ncaagaaagtgcccatttn

SEQ ID NO: 152 - RNA, 19 nt, synthetic construct
  source 1..19: mol_type = other RNA
tgacaagaaagtgcccatt

SEQ ID NO: 153 - RNA, 19 nt, synthetic construct
  source 1..19: mol_type = other RNA
agacaagaaagtgcccatt

SEQ ID NO: 154 - RNA, 19 nt, synthetic construct
  source 1..19: mol_type = other RNA
ngacaagaaagtgcccatt

SEQ ID NO: 155 - RNA, 19 nt, synthetic construct
  source 1..19: mol_type = other RNA
ngacaagaaagtgcccatn

SEQ ID NO: 156 - RNA, 19 nt, synthetic construct
  source 1..19: mol_type = other RNA
caacacatcagccaacctg

SEQ ID NO: 157 - RNA, 19 nt, synthetic construct
  source 1..19: mol_type = other RNA
aaacacatcagccaacctg

SEQ ID NO: 158 - RNA, 19 nt, synthetic construct
  source 1..19: mol_type = other RNA
taacacatcagccaacctg

SEQ ID NO: 159 - RNA, 19 nt, synthetic construct
  source 1..19: mol_type = other RNA
naacacatcagccaacctg

SEQ ID NO: 160 - RNA, 19 nt, synthetic construct
  source 1..19: mol_type = other RNA
naacacatcagccaacctn

SEQ ID NO: 161 - RNA, 19 nt, synthetic construct
  source 1..19: mol_type = other RNA
ccatctatctgcttcctcc

SEQ ID NO: 162 - RNA, 19 nt, synthetic construct
  source 1..19: mol_type = other RNA
tcatctatctgcttcctcc

SEQ ID NO: 163 - RNA, 19 nt, synthetic construct
  source 1..19: mol_type = other RNA
acatctatctgcttcctcc

SEQ ID NO: 164 - RNA, 19 nt, synthetic construct
  source 1..19: mol_type = other RNA
ncatctatctgcttcctcc

SEQ ID NO: 165 - RNA, 19 nt, synthetic construct
  source 1..19: mol_type = other RNA
ncatctatctgcttcctcn

SEQ ID NO: 166 - RNA, 19 nt, synthetic construct
  source 1..19: mol_type = other RNA
tgcttaccctgcttcaagc

SEQ ID NO: 167 - RNA, 19 nt, synthetic construct
  source 1..19: mol_type = other RNA
agcttaccctgcttcaagc

SEQ ID NO: 168 - RNA, 19 nt, synthetic construct
  source 1..19: mol_type = other RNA
ngcttaccctgcttcaagc

SEQ ID NO: 169 - RNA, 19 nt, synthetic construct
  source 1..19: mol_type = other RNA
ngcttaccctgcttcaagn

SEQ ID NO: 170 - RNA, 19 nt, synthetic construct
  source 1..19: mol_type = other RNA
ctgcttaccctgcttcaag

SEQ ID NO: 171 - RNA, 19 nt, synthetic construct
  source 1..19: mol_type = other RNA
atgcttaccctgcttcaag

SEQ ID NO: 172 - RNA, 19 nt, synthetic construct
  source 1..19: mol_type = other RNA
ttgcttaccctgcttcaag

SEQ ID NO: 173 - RNA, 19 nt, synthetic construct
  source 1..19: mol_type = other RNA
ntgcttaccctgcttcaag

SEQ ID NO: 174 - RNA, 19 nt, synthetic construct
  source 1..19: mol_type = other RNA
ntgcttaccctgcttcaan

SEQ ID NO: 175 - RNA, 19 nt, synthetic construct
  source 1..19: mol_type = other RNA
ggaacttcttaggcttagt

SEQ ID NO: 176 - RNA, 19 nt, synthetic construct
  source 1..19: mol_type = other RNA
tgaacttcttaggcttagt

SEQ ID NO: 177 - RNA, 19 nt, synthetic construct
  source 1..19: mol_type = other RNA
agaacttcttaggcttagt

SEQ ID NO: 178 - RNA, 19 nt, synthetic construct
  source 1..19: mol_type = other RNA
ngaacttcttaggcttagt

SEQ ID NO: 179 - RNA, 19 nt, synthetic construct
  source 1..19: mol_type = other RNA
ngaacttcttaggcttagn

SEQ ID NO: 180 - RNA, 19 nt, synthetic construct
  source 1..19: mol_type = other RNA
ataaatgcttgtctcccag

SEQ ID NO: 181 - RNA, 19 nt, synthetic construct
  source 1..19: mol_type = other RNA
ttaaatgcttgtctcccag

SEQ ID NO: 182 - RNA, 19 nt, synthetic construct
  source 1..19: mol_type = other RNA
ntaaatgcttgtctcccag

SEQ ID NO: 183 - RNA, 19 nt, synthetic construct
  source 1..19: mol_type = other RNA
ntaaatgcttgtctcccan

SEQ ID NO: 184 - RNA, 19 nt, synthetic construct
  source 1..19: mol_type = other RNA
aagtataaatgcttgtctc

SEQ ID NO: 185 - RNA, 19 nt, synthetic construct
  source 1..19: mol_type = other RNA
tagtataaatgcttgtctc

SEQ ID NO: 186 - RNA, 19 nt, synthetic construct
  source 1..19: mol_type = other RNA
nagtataaatgcttgtctc

SEQ ID NO: 187 - RNA, 19 nt, synthetic construct
  source 1..19: mol_type = other RNA
nagtataaatgcttgtctn

SEQ ID NO: 188 - RNA, 19 nt, synthetic construct
  source 1..19: mol_type = other RNA
aaagtataaatgcttgtct

SEQ ID NO: 189 - RNA, 19 nt, synthetic construct
  source 1..19: mol_type = other RNA
taagtataaatgcttgtct

SEQ ID NO: 190 - RNA, 19 nt, synthetic construct
  source 1..19: mol_type = other RNA
naagtataaatgcttgtct

SEQ ID NO: 191 - RNA, 19 nt, synthetic construct
  source 1..19: mol_type = other RNA
naagtataaatgcttgtcn

SEQ ID NO: 192 - RNA, 19 nt, synthetic construct
  source 1..19: mol_type = other RNA
taagaaagtataagccagg

SEQ ID NO: 193 - RNA, 19 nt, synthetic construct
  source 1..19: mol_type = other RNA
aaagaaagtataagccagg

SEQ ID NO: 194 - RNA, 19 nt, synthetic construct
  source 1..19: mol_type = other RNA
naagaaagtataagccagg

SEQ ID NO: 195 - RNA, 19 nt, synthetic construct
  source 1..19: mol_type = other RNA
naagaaagtataagccagn

SEQ ID NO: 196 - RNA, 19 nt, synthetic construct
  source 1..19: mol_type = other RNA
ttaagaaagtataagccag

SEQ ID NO: 197 - RNA, 19 nt, synthetic construct
  source 1..19: mol_type = other RNA
ataagaaagtataagccag

SEQ ID NO: 198 - RNA, 19 nt, synthetic construct
  source 1..19: mol_type = other RNA
ntaagaaagtataagccag

SEQ ID NO: 199 - RNA, 19 nt, synthetic construct
  source 1..19: mol_type = other RNA
ntaagaaagtataagccan

SEQ ID NO: 200 - RNA, 19 nt, synthetic construct
  source 1..19: mol_type = other RNA
tattaagaaagtataagcc

SEQ ID NO: 201 - RNA, 19 nt, synthetic construct
  source 1..19: mol_type = other RNA
aattaagaaagtataagcc

SEQ ID NO: 202 - RNA, 19 nt, synthetic construct
  source 1..19: mol_type = other RNA
nattaagaaagtataagcc

SEQ ID NO: 203 - RNA, 19 nt, synthetic construct
  source 1..19: mol_type = other RNA
nattaagaaagtataagcn

SEQ ID NO: 204 - RNA, 19 nt, synthetic construct
  source 1..19: mol_type = other RNA
cagtcgtcccagaataact

SEQ ID NO: 205 - RNA, 19 nt, synthetic construct
  source 1..19: mol_type = other RNA
cagtcgtcccagaataaca

SEQ ID NO: 206 - RNA, 19 nt, synthetic construct
  source 1..19: mol_type = other RNA
cagtcgtcccagaataacn

SEQ ID NO: 207 - RNA, 19 nt, synthetic construct
  source 1..19: mol_type = other RNA
nagtcgtcccagaataacn

SEQ ID NO: 208 - RNA, 19 nt, synthetic construct
  source 1..19: mol_type = other RNA
gtcacagactccacttcag

SEQ ID NO: 209 - RNA, 19 nt, synthetic construct
  source 1..19: mol_type = other RNA
gtcacagactccacttcaa

SEQ ID NO: 210 - RNA, 19 nt, synthetic construct
  source 1..19: mol_type = other RNA
gtcacagactccacttcat

SEQ ID NO: 211 - RNA, 19 nt, synthetic construct
  source 1..19: mol_type = other RNA
gtcacagactccacttcan

SEQ ID NO: 212 - RNA, 19 nt, synthetic construct
  source 1..19: mol_type = other RNA
ntcacagactccacttcan

SEQ ID NO: 213 - RNA, 19 nt, synthetic construct
  source 1..19: mol_type = other RNA
ccacttcagcctacagctc

SEQ ID NO: 214 - RNA, 19 nt, synthetic construct
  source 1..19: mol_type = other RNA
ccacttcagcctacagcta

SEQ ID NO: 215 - RNA, 19 nt, synthetic construct
  source 1..19: mol_type = other RNA
ccacttcagcctacagctt

SEQ ID NO: 216 - RNA, 19 nt, synthetic construct
  source 1..19: mol_type = other RNA
ccacttcagcctacagctn

SEQ ID NO: 217 - RNA, 19 nt, synthetic construct
  source 1..19: mol_type = other RNA
ncacttcagcctacagctn

SEQ ID NO: 218 - RNA, 19 nt, synthetic construct
  source 1..19: mol_type = other RNA
ggcactctttgcttgagga

SEQ ID NO: 219 - RNA, 19 nt, synthetic construct
  source 1..19: mol_type = other RNA
ggcactctttgcttgaggt

SEQ ID NO: 220 - RNA, 19 nt, synthetic construct
  source 1..19: mol_type = other RNA
ggcactctttgcttgaggn

SEQ ID NO: 221 - RNA, 19 nt, synthetic construct
  source 1..19: mol_type = other RNA
ngcactctttgcttgaggn

SEQ ID NO: 222 - RNA, 19 nt, synthetic construct
  source 1..19: mol_type = other RNA
actctttgcttgaggatct

SEQ ID NO: 223 - RNA, 19 nt, synthetic construct
  source 1..19: mol_type = other RNA
actctttgcttgaggatca

SEQ ID NO: 224 - RNA, 19 nt, synthetic construct
  source 1..19: mol_type = other RNA
actctttgcttgaggatcn

SEQ ID NO: 225 - RNA, 19 nt, synthetic construct
  source 1..19: mol_type = other RNA
nctctttgcttgaggatcn

SEQ ID NO: 226 - RNA, 19 nt, synthetic construct
  source 1..19: mol_type = other RNA
tgcttgaggatcttccgat

SEQ ID NO: 227 - RNA, 19 nt, synthetic construct
  source 1..19: mol_type = other RNA
tgcttgaggatcttccgaa

SEQ ID NO: 228 - RNA, 19 nt, synthetic construct
  source 1..19: mol_type = other RNA
tgcttgaggatcttccgan

SEQ ID NO: 229 - RNA, 19 nt, synthetic construct
  source 1..19: mol_type = other RNA
ngcttgaggatcttccgan

SEQ ID NO: 230 - RNA, 19 nt, synthetic construct
  source 1..19: mol_type = other RNA
caccacatcaccaacctgg

SEQ ID NO: 231 - RNA, 19 nt, synthetic construct
  source 1..19: mol_type = other RNA
caccacatcaccaacctga

SEQ ID NO: 232 - RNA, 19 nt, synthetic construct
  source 1..19: mol_type = other RNA
caccacatcaccaacctgt

SEQ ID NO: 233 - RNA, 19 nt, synthetic construct
  source 1..19: mol_type = other RNA
caccacatcaccaacctgn

SEQ ID NO: 234 - RNA, 19 nt, synthetic construct
  source 1..19: mol_type = other RNA
naccacatcaccaacctgn

SEQ ID NO: 235 - RNA, 19 nt, synthetic construct
  source 1..19: mol_type = other RNA
tcctgaaactgcaactaga

SEQ ID NO: 236 - RNA, 19 nt, synthetic construct
  source 1..19: mol_type = other RNA
tcctgaaactgcaactagt

SEQ ID NO: 237 - RNA, 19 nt, synthetic construct
  source 1..19: mol_type = other RNA
tcctgaaactgcaactagn

SEQ ID NO: 238 - RNA, 19 nt, synthetic construct
  source 1..19: mol_type = other RNA
ncctgaaactgcaactagn

SEQ ID NO: 239 - RNA, 19 nt, synthetic construct
  source 1..19: mol_type = other RNA
cctgaaactgcaactagac

SEQ ID NO: 240 - RNA, 19 nt, synthetic construct
  source 1..19: mol_type = other RNA
cctgaaactgcaactagaa

SEQ ID NO: 241 - RNA, 19 nt, synthetic construct
  source 1..19: mol_type = other RNA
cctgaaactgcaactagat

SEQ ID NO: 242 - RNA, 19 nt, synthetic construct
  source 1..19: mol_type = other RNA
cctgaaactgcaactagan

SEQ ID NO: 243 - RNA, 19 nt, synthetic construct
  source 1..19: mol_type = other RNA
nctgaaactgcaactagan

SEQ ID NO: 244 - RNA, 19 nt, synthetic construct
  source 1..19: mol_type = other RNA
ttcctagagcttaagatcc

SEQ ID NO: 245 - RNA, 19 nt, synthetic construct
  source 1..19: mol_type = other RNA
ttcctagagcttaagatct

SEQ ID NO: 246 - RNA, 19 nt, synthetic construct
  source 1..19: mol_type = other RNA
ttcctagagcttaagatca

SEQ ID NO: 247 - RNA, 19 nt, synthetic construct
  source 1..19: mol_type = other RNA
ttcctagagcttaagatcn

SEQ ID NO: 248 - RNA, 19 nt, synthetic construct
  source 1..19: mol_type = other RNA
ntcctagagcttaagatcn

SEQ ID NO: 249 - RNA, 19 nt, synthetic construct
  source 1..19: mol_type = other RNA
ctagagcttaagatccgag

SEQ ID NO: 250 - RNA, 19 nt, synthetic construct
  source 1..19: mol_type = other RNA
ctagagcttaagatccgaa

SEQ ID NO: 251 - RNA, 19 nt, synthetic construct
  source 1..19: mol_type = other RNA
ctagagcttaagatccgat

SEQ ID NO: 252 - RNA, 19 nt, synthetic construct
  source 1..19: mol_type = other RNA
ctagagcttaagatccgan

SEQ ID NO: 253 - RNA, 19 nt, synthetic construct
  source 1..19: mol_type = other RNA
ntagagcttaagatccgan

SEQ ID NO: 254 - RNA, 19 nt, synthetic construct
  source 1..19: mol_type = other RNA
ggtaccagctgaattactg

SEQ ID NO: 255 - RNA, 19 nt, synthetic construct
  source 1..19: mol_type = other RNA
ggtaccagctgaattactt

SEQ ID NO: 256 - RNA, 19 nt, synthetic construct
  source 1..19: mol_type = other RNA
ggtaccagctgaattacta

SEQ ID NO: 257 - RNA, 19 nt, synthetic construct
  source 1..19: mol_type = other RNA
ggtaccagctgaattactn

SEQ ID NO: 258 - RNA, 19 nt, synthetic construct
  source 1..19: mol_type = other RNA
ngtaccagctgaattactn

SEQ ID NO: 259 - RNA, 19 nt, synthetic construct
  source 1..19: mol_type = other RNA
taccagctgaattactgca

SEQ ID NO: 260 - RNA, 19 nt, synthetic construct
  source 1..19: mol_type = other RNA
taccagctgaattactgct

SEQ ID NO: 261 - RNA, 19 nt, synthetic construct
  source 1..19: mol_type = other RNA
taccagctgaattactgcn

SEQ ID NO: 262 - RNA, 19 nt, synthetic construct
  source 1..19: mol_type = other RNA
naccagctgaattactgcn

SEQ ID NO: 263 - RNA, 19 nt, synthetic construct
  source 1..19: mol_type = other RNA
gctgcctctttccattctg

SEQ ID NO: 264 - RNA, 19 nt, synthetic construct
  source 1..19: mol_type = other RNA
gctgcctctttccattctt

SEQ ID NO: 265 - RNA, 19 nt, synthetic construct
  source 1..19: mol_type = other RNA
gctgcctctttccattcta

SEQ ID NO: 266 - RNA, 19 nt, synthetic construct
  source 1..19: mol_type = other RNA
gctgcctctttccattctn

SEQ ID NO: 267 - RNA, 19 nt, synthetic construct
  source 1..19: mol_type = other RNA
nctgcctctttccattctn

SEQ ID NO: 268 - RNA, 19 nt, synthetic construct
  source 1..19: mol_type = other RNA
ctgcctctttccattctgc

SEQ ID NO: 269 - RNA, 19 nt, synthetic construct
  source 1..19: mol_type = other RNA
ctgcctctttccattctga

SEQ ID NO: 270 - RNA, 19 nt, synthetic construct
  source 1..19: mol_type = other RNA
ctgcctctttccattctgt

SEQ ID NO: 271 - RNA, 19 nt, synthetic construct
  source 1..19: mol_type = other RNA
ctgcctctttccattctgn

SEQ ID NO: 272 - RNA, 19 nt, synthetic construct
  source 1..19: mol_type = other RNA
ntgcctctttccattctgn

SEQ ID NO: 273 - RNA, 19 nt, synthetic construct
  source 1..19: mol_type = other RNA
tcctctacctggatcataa

SEQ ID NO: 274 - RNA, 19 nt, synthetic construct
  source 1..19: mol_type = other RNA
tcctctacctggatcatat

SEQ ID NO: 275 - RNA, 19 nt, synthetic construct
  source 1..19: mol_type = other RNA
tcctctacctggatcatan

SEQ ID NO: 276 - RNA, 19 nt, synthetic construct
  source 1..19: mol_type = other RNA
ncctctacctggatcatan

SEQ ID NO: 277 - RNA, 19 nt, synthetic construct
  source 1..19: mol_type = other RNA
ataatggcaatgtggtcaa

SEQ ID NO: 278 - RNA, 19 nt, synthetic construct
  source 1..19: mol_type = other RNA
ataatggcaatgtggtcat

SEQ ID NO: 279 - RNA, 19 nt, synthetic construct
  source 1..19: mol_type = other RNA
ataatggcaatgtggtcan

SEQ ID NO: 280 - RNA, 19 nt, synthetic construct
  source 1..19: mol_type = other RNA
ntaatggcaatgtggtcan

SEQ ID NO: 281 - RNA, 19 nt, synthetic construct
  source 1..19: mol_type = other RNA
aatggcaatgtggtcaaga

SEQ ID NO: 282 - RNA, 19 nt, synthetic construct
  source 1..19: mol_type = other RNA
aatggcaatgtggtcaagt

SEQ ID NO: 283 - RNA, 19 nt, synthetic construct
  source 1..19: mol_type = other RNA
aatggcaatgtggtcaagn

SEQ ID NO: 284 - RNA, 19 nt, synthetic construct
  source 1..19: mol_type = other RNA
natggcaatgtggtcaagn

SEQ ID NO: 285 - RNA, 19 nt, synthetic construct
  source 1..19: mol_type = other RNA
agtgaagagaccaagatga

SEQ ID NO: 286 - RNA, 19 nt, synthetic construct
  source 1..19: mol_type = other RNA
agtgaagagaccaagatgt

SEQ ID NO: 287 - RNA, 19 nt, synthetic construct
  source 1..19: mol_type = other RNA
agtgaagagaccaagatgn

SEQ ID NO: 288 - RNA, 19 nt, synthetic construct
  source 1..19: mol_type = other RNA
ngtgaagagaccaagatgn

SEQ ID NO: 289 - RNA, 19 nt, synthetic construct
  source 1..19: mol_type = other RNA
actggaggcatcagattcc

SEQ ID NO: 290 - RNA, 19 nt, synthetic construct
  source 1..19: mol_type = other RNA
actggaggcatcagattct

SEQ ID NO: 291 - RNA, 19 nt, synthetic construct
  source 1..19: mol_type = other RNA
actggaggcatcagattca

SEQ ID NO: 292 - RNA, 19 nt, synthetic construct
  source 1..19: mol_type = other RNA
actggaggcatcagattcn

SEQ ID NO: 293 - RNA, 19 nt, synthetic construct
  source 1..19: mol_type = other RNA
nctggaggcatcagattcn

SEQ ID NO: 294 - RNA, 19 nt, synthetic construct
  source 1..19: mol_type = other RNA
ccacctggcaatatgactc

SEQ ID NO: 295 - RNA, 19 nt, synthetic construct
  source 1..19: mol_type = other RNA
ccacctggcaatatgactt

SEQ ID NO: 296 - RNA, 19 nt, synthetic construct
  source 1..19: mol_type = other RNA
ccacctggcaatatgacta

SEQ ID NO: 297 - RNA, 19 nt, synthetic construct
  source 1..19: mol_type = other RNA
ccacctggcaatatgactn

SEQ ID NO: 298 - RNA, 19 nt, synthetic construct
  source 1..19: mol_type = other RNA
ncacctggcaatatgactn

SEQ ID NO: 299 - RNA, 19 nt, synthetic construct
  source 1..19: mol_type = other RNA
tggcaatatgactcacttg

SEQ ID NO: 300 - RNA, 19 nt, synthetic construct
  source 1..19: mol_type = other RNA
tggcaatatgactcactta

SEQ ID NO: 301 - RNA, 19 nt, synthetic construct
  source 1..19: mol_type = other RNA
tggcaatatgactcacttt

SEQ ID NO: 302 - RNA, 19 nt, synthetic construct
  source 1..19: mol_type = other RNA
tggcaatatgactcacttn

SEQ ID NO: 303 - RNA, 19 nt, synthetic construct
  source 1..19: mol_type = other RNA
nggcaatatgactcacttn

SEQ ID NO: 304 - RNA, 19 nt, synthetic construct
  source 1..19: mol_type = other RNA
actcacttgacccctatgg

SEQ ID NO: 305 - RNA, 19 nt, synthetic construct
  source 1..19: mol_type = other RNA
actcacttgacccctatgt

SEQ ID NO: 306 - RNA, 19 nt, synthetic construct
  source 1..19: mol_type = other RNA
actcacttgacccctatga

SEQ ID NO: 307 - RNA, 19 nt, synthetic construct
  source 1..19: mol_type = other RNA
actcacttgacccctatgn

SEQ ID NO: 308 - RNA, 19 nt, synthetic construct
  source 1..19: mol_type = other RNA
nctcacttgacccctatgn

SEQ ID NO: 309 - RNA, 19 nt, synthetic construct
  source 1..19: mol_type = other RNA
acccaaatgggcactttct

SEQ ID NO: 310 - RNA, 19 nt, synthetic construct
  source 1..19: mol_type = other RNA
acccaaatgggcactttca

SEQ ID NO: 311 - RNA, 19 nt, synthetic construct
  source 1..19: mol_type = other RNA
acccaaatgggcactttcn

SEQ ID NO: 312 - RNA, 19 nt, synthetic construct
  source 1..19: mol_type = other RNA
ncccaaatgggcactttcn

SEQ ID NO: 313 - RNA, 19 nt, synthetic construct
  source 1..19: mol_type = other RNA
caaatgggcactttcttgt

SEQ ID NO: 314 - RNA, 19 nt, synthetic construct
  source 1..19: mol_type = other RNA
caaatgggcactttcttga

SEQ ID NO: 315 - RNA, 19 nt, synthetic construct
  source 1..19: mol_type = other RNA
caaatgggcactttcttgn

SEQ ID NO: 316 - RNA, 19 nt, synthetic construct
  source 1..19: mol_type = other RNA
naaatgggcactttcttgn

SEQ ID NO: 317 - RNA, 19 nt, synthetic construct
  source 1..19: mol_type = other RNA
aatgggcactttcttgtct

SEQ ID NO: 318 - RNA, 19 nt, synthetic construct
  source 1..19: mol_type = other RNA
aatgggcactttcttgtca

SEQ ID NO: 319 - RNA, 19 nt, synthetic construct
  source 1..19: mol_type = other RNA
aatgggcactttcttgtcn

SEQ ID NO: 320 - RNA, 19 nt, synthetic construct
  source 1..19: mol_type = other RNA
natgggcactttcttgtcn

SEQ ID NO: 321 - RNA, 19 nt, synthetic construct
  source 1..19: mol_type = other RNA
caggttggctgatgtgttg

SEQ ID NO: 322 - RNA, 19 nt, synthetic construct
  source 1..19: mol_type = other RNA
caggttggctgatgtgttt

SEQ ID NO: 323 - RNA, 19 nt, synthetic construct
  source 1..19: mol_type = other RNA
caggttggctgatgtgtta

SEQ ID NO: 324 - RNA, 19 nt, synthetic construct
  source 1..19: mol_type = other RNA
caggttggctgatgtgttn

SEQ ID NO: 325 - RNA, 19 nt, synthetic construct
  source 1..19: mol_type = other RNA
naggttggctgatgtgttn

SEQ ID NO: 326 - RNA, 19 nt, synthetic construct
  source 1..19: mol_type = other RNA
ggaggaagcagatagatgg

SEQ ID NO: 327 - RNA, 19 nt, synthetic construct
  source 1..19: mol_type = other RNA
ggaggaagcagatagatga

SEQ ID NO: 328 - RNA, 19 nt, synthetic construct
  source 1..19: mol_type = other RNA
ggaggaagcagatagatgt

SEQ ID NO: 329 - RNA, 19 nt, synthetic construct
  source 1..19: mol_type = other RNA
ggaggaagcagatagatgn

SEQ ID NO: 330 - RNA, 19 nt, synthetic construct
  source 1..19: mol_type = other RNA
ngaggaagcagatagatgn

SEQ ID NO: 331 - RNA, 19 nt, synthetic construct
  source 1..19: mol_type = other RNA
gcttgaagcagggtaagca

SEQ ID NO: 332 - RNA, 19 nt, synthetic construct
  source 1..19: mol_type = other RNA
gcttgaagcagggtaagct

SEQ ID NO: 333 - RNA, 19 nt, synthetic construct
  source 1..19: mol_type = other RNA
gcttgaagcagggtaagcn

SEQ ID NO: 334 - RNA, 19 nt, synthetic construct
  source 1..19: mol_type = other RNA
ncttgaagcagggtaagcn

SEQ ID NO: 335 - RNA, 19 nt, synthetic construct
  source 1..19: mol_type = other RNA
cttgaagcagggtaagcag

SEQ ID NO: 336 - RNA, 19 nt, synthetic construct
  source 1..19: mol_type = other RNA
cttgaagcagggtaagcat

SEQ ID NO: 337 - RNA, 19 nt, synthetic construct
  source 1..19: mol_type = other RNA
cttgaagcagggtaagcaa

SEQ ID NO: 338 - RNA, 19 nt, synthetic construct
  source 1..19: mol_type = other RNA
cttgaagcagggtaagcan

SEQ ID NO: 339 - RNA, 19 nt, synthetic construct
  source 1..19: mol_type = other RNA
nttgaagcagggtaagcan

SEQ ID NO: 340 - RNA, 19 nt, synthetic construct
  source 1..19: mol_type = other RNA
actaagcctaagaagttcc

SEQ ID NO: 341 - RNA, 19 nt, synthetic construct
  source 1..19: mol_type = other RNA
actaagcctaagaagttca

SEQ ID NO: 342 - RNA, 19 nt, synthetic construct
  source 1..19: mol_type = other RNA
actaagcctaagaagttct

SEQ ID NO: 343 - RNA, 19 nt, synthetic construct
  source 1..19: mol_type = other RNA
actaagcctaagaagttcn

SEQ ID NO: 344 - RNA, 19 nt, synthetic construct
  source 1..19: mol_type = other RNA
nctaagcctaagaagttcn

SEQ ID NO: 345 - RNA, 19 nt, synthetic construct
  source 1..19: mol_type = other RNA
ctgggagacaagcatttat

SEQ ID NO: 346 - RNA, 19 nt, synthetic construct
  source 1..19: mol_type = other RNA
ctgggagacaagcatttaa

SEQ ID NO: 347 - RNA, 19 nt, synthetic construct
  source 1..19: mol_type = other RNA
ctgggagacaagcatttan

SEQ ID NO: 348 - RNA, 19 nt, synthetic construct
  source 1..19: mol_type = other RNA
ntgggagacaagcatttan

SEQ ID NO: 349 - RNA, 19 nt, synthetic construct
  source 1..19: mol_type = other RNA
gagacaagcatttatactt

SEQ ID NO: 350 - RNA, 19 nt, synthetic construct
  source 1..19: mol_type = other RNA
gagacaagcatttatacta

SEQ ID NO: 351 - RNA, 19 nt, synthetic construct
  source 1..19: mol_type = other RNA
gagacaagcatttatactn

SEQ ID NO: 352 - RNA, 19 nt, synthetic construct
  source 1..19: mol_type = other RNA
nagacaagcatttatactn

SEQ ID NO: 353 - RNA, 19 nt, synthetic construct
  source 1..19: mol_type = other RNA
agacaagcatttatacttt

SEQ ID NO: 354 - RNA, 19 nt, synthetic construct
  source 1..19: mol_type = other RNA
agacaagcatttatactta

SEQ ID NO: 355 - RNA, 19 nt, synthetic construct
  source 1..19: mol_type = other RNA
agacaagcatttatacttn

SEQ ID NO: 356 - RNA, 19 nt, synthetic construct
  source 1..19: mol_type = other RNA
ngacaagcatttatacttn

SEQ ID NO: 357 - RNA, 19 nt, synthetic construct
  source 1..19: mol_type = other RNA
cctggcttatactttctta

SEQ ID NO: 358 - RNA, 19 nt, synthetic construct
  source 1..19: mol_type = other RNA
cctggcttatactttcttt

SEQ ID NO: 359 - RNA, 19 nt, synthetic construct
  source 1..19: mol_type = other RNA
cctggcttatactttcttn

SEQ ID NO: 360 - RNA, 19 nt, synthetic construct
  source 1..19: mol_type = other RNA
nctggcttatactttcttn

SEQ ID NO: 361 - RNA, 19 nt, synthetic construct
  source 1..19: mol_type = other RNA
ctggcttatactttcttaa

SEQ ID NO: 362 - RNA, 19 nt, synthetic construct
  source 1..19: mol_type = other RNA
ctggcttatactttcttat

SEQ ID NO: 363 - RNA, 19 nt, synthetic construct
  source 1..19: mol_type = other RNA
ctggcttatactttcttan

SEQ ID NO: 364 - RNA, 19 nt, synthetic construct
  source 1..19: mol_type = other RNA
ntggcttatactttcttan

SEQ ID NO: 365 - RNA, 19 nt, synthetic construct
  source 1..19: mol_type = other RNA
ggcttatactttcttaata

SEQ ID NO: 366 - RNA, 19 nt, synthetic construct
  source 1..19: mol_type = other RNA
ggcttatactttcttaatt

SEQ ID NO: 367 - RNA, 19 nt, synthetic construct
  source 1..19: mol_type = other RNA
ggcttatactttcttaatn

SEQ ID NO: 368 - RNA, 19 nt, synthetic construct
  source 1..19: mol_type = other RNA
ngcttatactttcttaatn

SEQ ID NO: 369 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
agttattctgggacgactggt

SEQ ID NO: 370 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggacgactggt

SEQ ID NO: 371 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = um
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattttgggacgactggt

SEQ ID NO: 372 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggatgactggt

SEQ ID NO: 373 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggacgattggt

SEQ ID NO: 374 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggatgattggt

SEQ ID NO: 375 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = um
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = um
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattttgggacgattggt

SEQ ID NO: 376 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-deoxythymidine
  modified_base 8: mod_base = cm
  modified_base 9: mod_base = um
  modified_base 10: mod_base = gm
  modified_base 11: mod_base = gm
  modified_base 12: mod_base = OTHER; note = 2 -deoxyguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2 -deoxyadenosine
  modified_base 17: mod_base = um
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggacgattggt

SEQ ID NO: 377 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-deoxythymidine
  modified_base 8: mod_base = cm
  modified_base 9: mod_base = um
  modified_base 10: mod_base = gm
  modified_base 11: mod_base = gm
  modified_base 12: mod_base = OTHER; note = 2 -deoxyguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2 -deoxyadenosine
  modified_base 17: mod_base = OTHER; note = 2'-deoxythymidine
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggacgattggt

SEQ ID NO: 378 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = OTHER; note = 2'-O-methyladenosine
  source 1..21: mol_type = other RNA
ttcggaagatcctcaagcaaa

SEQ ID NO: 379 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
ttcggaagatcctcaagcaat

SEQ ID NO: 380 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2',3'-seco-adenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..24: mol_type = other RNA
ttcggaatnagatcctcaagcaat

SEQ ID NO: 381 - RNA, 24 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2',3'-seco-adenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..24: mol_type = other RNA
ttcggaatnagatcctcaagcaat

SEQ ID NO: 382 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorodithioate linkage
  modified_base 21: mod_base = um
  source 1..21: mol_type = other RNA
ttgaccacattgccattatgt

SEQ ID NO: 383 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = um
  modified_base 9: mod_base = gm
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
ttgtctatgatggtagcaaag

SEQ ID NO: 384 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = um
  source 1..21: mol_type = other RNA
ttatgatccaggtagaggagt

SEQ ID NO: 385 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = um
  source 1..21: mol_type = other RNA
ttatgatccaggtagaggagt

SEQ ID NO: 386 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-deoxythymidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
tgttattctgggatgactggt

SEQ ID NO: 387 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-deoxythymidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 20: mod_base = gm
  modified_base 20^21: mod_base = OTHER; note = phosphorodithioate linkage
  modified_base 21: mod_base = um
  source 1..21: mol_type = other RNA
tgttattctgggatgactggt

SEQ ID NO: 388 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 20: mod_base = gm
  modified_base 20^21: mod_base = OTHER; note = phosphorodithioate linkage
  modified_base 21: mod_base = um
  source 1..21: mol_type = other RNA
tgttattctgggatgactggt

SEQ ID NO: 389 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2 -deoxyadenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 20: mod_base = gm
  modified_base 20^21: mod_base = OTHER; note = phosphorodithioate linkage
  modified_base 21: mod_base = um
  source 1..21: mol_type = other RNA
tgttattctgggatgactggt

SEQ ID NO: 390 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2 -deoxyadenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-deoxythymidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 20: mod_base = gm
  modified_base 20^21: mod_base = OTHER; note = phosphorodithioate linkage
  modified_base 21: mod_base = um
  source 1..21: mol_type = other RNA
tgttattctgggatgactggt

SEQ ID NO: 391 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 392 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 393 - RNA, 21 nt, synthetic construct
  modified_base 1: mod_base = OTHER; note = 2 -O-methylinosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
ngttattctgggatgactggt

SEQ ID NO: 394 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
tgttattctgggatgactggc

SEQ ID NO: 395 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2 -O-methylinosine
  source 1..21: mol_type = other RNA
ttgaccacattgccattatgn

SEQ ID NO: 396 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2 -O-methylinosine
  source 1..21: mol_type = other RNA
ttatgatccaggtagaggagn

SEQ ID NO: 397 - RNA, 21 nt, synthetic construct
  modified_base 1: mod_base = OTHER; note = 2 -O-methylinosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluorouridine
  modified_base 8: mod_base = cm
  modified_base 9: mod_base = um
  modified_base 10: mod_base = gm
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-fluoroadenosine
  modified_base 17: mod_base = cm
  modified_base 18: mod_base = um
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = um
  source 1..21: mol_type = other RNA
ngttattctgggacgactggt

SEQ ID NO: 398 - RNA, 21 nt, synthetic construct
  modified_base 1: mod_base = OTHER; note = 2 -O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
ntcggaagatcctcaagcaaa

SEQ ID NO: 399 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2 -O-methylinosine
  source 1..21: mol_type = other RNA
atcggaagatcctcaagcaan

SEQ ID NO: 400 - RNA, 21 nt, synthetic construct
  modified_base 1: mod_base = OTHER; note = 2 -O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2 -O-methylinosine
  source 1..21: mol_type = other RNA
ntcggaagatcctcaagcaan

SEQ ID NO: 401 - RNA, 21 nt, synthetic construct
  modified_base 1: mod_base = OTHER; note = 2 -O-methylinosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
ntcggaagatcctcaagcaat

SEQ ID NO: 402 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
tttggaagatcctcaagcaat

SEQ ID NO: 403 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
ttcggaagatcctcaagcaat

SEQ ID NO: 404 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
ttcggaagatcctcaagcaat

SEQ ID NO: 405 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = um
  source 1..21: mol_type = other RNA
ttcggaagatccttaagcaat

SEQ ID NO: 406 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 407 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 408 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = cm
  modified_base 5: mod_base = um
  modified_base 6: mod_base = gm
  modified_base 7: mod_base = OTHER; note = 2'-fluorouridine
  modified_base 8: mod_base = OTHER; note = 2'-O-methyladenosine
  modified_base 9: mod_base = gm
  modified_base 10: mod_base = gm
  modified_base 11: mod_base = cm
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = um
  modified_base 18: mod_base = gm
  modified_base 19: mod_base = gm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tagctgtaggctgaagtggag

SEQ ID NO: 409 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = cm
  modified_base 6: mod_base = cm
  modified_base 7: mod_base = OTHER; note = 2'-fluorouridine
  modified_base 8: mod_base = cm
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = gm
  modified_base 19: mod_base = um
  modified_base 20: mod_base = gm
  modified_base 20^21: mod_base = OTHER; note = phosphorodithioate linkage
  modified_base 21: mod_base = cm
  source 1..21: mol_type = other RNA
tgatcctcaagcaaagagtgc

SEQ ID NO: 410 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = gm
  modified_base 6: mod_base = um
  modified_base 7: mod_base = OTHER; note = 2'-fluorouridine
  modified_base 8: mod_base = gm
  modified_base 9: mod_base = gm
  modified_base 10: mod_base = um
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroguanosine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = gm
  modified_base 20: mod_base = cm
  modified_base 20^21: mod_base = OTHER; note = phosphorodithioate linkage
  modified_base 21: mod_base = um
  source 1..21: mol_type = other RNA
tcaggttggtgatgtggtgct

SEQ ID NO: 411 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = um
  modified_base 10: mod_base = um
  modified_base 11: mod_base = OTHER; note = 2'-O-methyladenosine
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = um
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorodithioate linkage
  modified_base 21: mod_base = um
  source 1..21: mol_type = other RNA
ttcggatcttaagctctaggt

SEQ ID NO: 412 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = gm
  modified_base 9: mod_base = gm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = cm
  modified_base 18: mod_base = OTHER; note = 2'-O-methyladenosine
  modified_base 19: mod_base = gm
  modified_base 20: mod_base = cm
  modified_base 20^21: mod_base = OTHER; note = phosphorodithioate linkage
  modified_base 21: mod_base = um
  source 1..21: mol_type = other RNA
tcagaatggaaagaggcagct

SEQ ID NO: 413 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = cm
  modified_base 6: mod_base = um
  modified_base 7: mod_base = OTHER; note = 2'-fluorouridine
  modified_base 8: mod_base = gm
  modified_base 9: mod_base = gm
  modified_base 10: mod_base = um
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = um
  modified_base 20: mod_base = cm
  modified_base 20^21: mod_base = OTHER; note = phosphorodithioate linkage
  modified_base 21: mod_base = cm
  source 1..21: mol_type = other RNA
tcatcttggtctcttcactcc

SEQ ID NO: 414 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = gm
  modified_base 7: mod_base = OTHER; note = 2'-fluoroadenosine
  modified_base 8: mod_base = gm
  modified_base 9: mod_base = um
  modified_base 10: mod_base = cm
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = cm
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = gm
  source 1..21: mol_type = other RNA
taagtgagtcatattgccagg

SEQ ID NO: 415 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = OTHER; note = 2'-fluorouridine
  modified_base 8: mod_base = gm
  modified_base 9: mod_base = cm
  modified_base 10: mod_base = cm
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorodithioate linkage
  modified_base 21: mod_base = cm
  source 1..21: mol_type = other RNA
tgaaagtgcccatttgggtcc

SEQ ID NO: 416 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 417 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = cm
  modified_base 6: mod_base = um
  modified_base 7: mod_base = OTHER; note = 2'-fluoroadenosine
  modified_base 8: mod_base = um
  modified_base 9: mod_base = cm
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = cm
  modified_base 20: mod_base = um
  modified_base 20^21: mod_base = OTHER; note = phosphorodithioate linkage
  modified_base 21: mod_base = cm
  source 1..21: mol_type = other RNA
tcatctatctgcttcctcctc

SEQ ID NO: 418 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroguanosine
  modified_base 8: mod_base = cm
  modified_base 9: mod_base = um
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = um
  modified_base 20^21: mod_base = OTHER; note = phosphorodithioate linkage
  modified_base 21: mod_base = gm
  source 1..21: mol_type = other RNA
ttaaatgcttgtctcccagtg

SEQ ID NO: 419 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = um
  modified_base 5: mod_base = OTHER; note = 2'-O-methyladenosine
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = um
  modified_base 19: mod_base = cm
  modified_base 20: mod_base = cm
  modified_base 20^21: mod_base = OTHER; note = phosphorodithioate linkage
  modified_base 21: mod_base = cm
  source 1..21: mol_type = other RNA
tagtataaatgcttgtctccc

SEQ ID NO: 420 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorouridine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = um
  modified_base 18: mod_base = cm
  modified_base 19: mod_base = um
  modified_base 20: mod_base = cm
  modified_base 20^21: mod_base = OTHER; note = phosphorodithioate linkage
  modified_base 21: mod_base = cm
  source 1..21: mol_type = other RNA
taagtataaatgcttgtctcc

SEQ ID NO: 421 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = um
  modified_base 10: mod_base = OTHER; note = 2'-O-methyladenosine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluoroguanosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = gm
  modified_base 19: mod_base = gm
  modified_base 20: mod_base = cm
  modified_base 20^21: mod_base = OTHER; note = phosphorodithioate linkage
  modified_base 21: mod_base = gm
  source 1..21: mol_type = other RNA
taagaaagtataagccaggcg

SEQ ID NO: 422 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = OTHER; note = 2'-O-methyladenosine
  modified_base 9: mod_base = gm
  modified_base 10: mod_base = um
  modified_base 11: mod_base = OTHER; note = 2'-O-methyladenosine
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = gm
  modified_base 20^21: mod_base = OTHER; note = phosphorodithioate linkage
  modified_base 21: mod_base = cm
  source 1..21: mol_type = other RNA
ttaagaaagtataagccaggc

SEQ ID NO: 423 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 424 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 425 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 426 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 427 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 428 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-fluoroadenosine
  modified_base 6: mod_base = um
  modified_base 7: mod_base = gm
  modified_base 8: mod_base = cm
  modified_base 9: mod_base = um
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = um
  modified_base 20^21: mod_base = OTHER; note = phosphorodithioate linkage
  modified_base 21: mod_base = gm
  source 1..21: mol_type = other RNA
ttaaatgcttgtctcccagtg

SEQ ID NO: 429 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroguanosine
  modified_base 8: mod_base = cm
  modified_base 9: mod_base = um
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = um
  modified_base 20^21: mod_base = OTHER; note = phosphorodithioate linkage
  modified_base 21: mod_base = gm
  source 1..21: mol_type = other RNA
ttaaatgcttgtctcccagtg

SEQ ID NO: 430 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroguanosine
  modified_base 8: mod_base = cm
  modified_base 9: mod_base = um
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorouridine
  modified_base 17: mod_base = cm
  modified_base 18: mod_base = OTHER; note = 2'-O-methyladenosine
  modified_base 19: mod_base = gm
  modified_base 20: mod_base = um
  modified_base 20^21: mod_base = OTHER; note = phosphorodithioate linkage
  modified_base 21: mod_base = gm
  source 1..21: mol_type = other RNA
ttaaatgcttgtctctcagtg

SEQ ID NO: 431 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = OTHER; note = 2'-fluoroguanosine
  modified_base 8: mod_base = cm
  modified_base 9: mod_base = um
  modified_base 10: mod_base = um
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-O-methyladenosine
  modified_base 19: mod_base = gm
  modified_base 20: mod_base = um
  modified_base 20^21: mod_base = OTHER; note = phosphorodithioate linkage
  modified_base 21: mod_base = gm
  source 1..21: mol_type = other RNA
ttaaatgcttgtctcccagtg

SEQ ID NO: 432 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatctg

SEQ ID NO: 433 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = cm
  modified_base 20^21: mod_base = OTHER; note = phosphorodithioate linkage
  modified_base 21: mod_base = gm
  source 1..21: mol_type = other RNA
tgacaagaaagtgcccattcg

SEQ ID NO: 434 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = cm
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatctg

SEQ ID NO: 435 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = cm
  modified_base 20^21: mod_base = OTHER; note = phosphorodithioate linkage
  modified_base 21: mod_base = gm
  source 1..21: mol_type = other RNA
tgacaagaaagtgcccattcg

SEQ ID NO: 436 - RNA, 22 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = OTHER; note = 2'-O-propargylguanosine
  source 1..22: mol_type = other RNA
tattaagaaagtataagccaga

SEQ ID NO: 437 - RNA, 22 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = OTHER; note = 2'-O-propargyluridine
  source 1..22: mol_type = other RNA
ttcggaagatcctcaagcaata

SEQ ID NO: 438 - RNA, 22 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = OTHER; note = 2'-O-propargylguanosine
  source 1..22: mol_type = other RNA
tgacaagaaagtgcccatttga

SEQ ID NO: 439 - RNA, 24 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2 -deoxyguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2 -deoxyadenosine
  modified_base 6: mod_base = um
  modified_base 7: mod_base = OTHER; note = 2'-deoxythymidine
  modified_base 8: mod_base = cm
  modified_base 9: mod_base = um
  modified_base 10: mod_base = gm
  modified_base 11: mod_base = gm
  modified_base 12: mod_base = OTHER; note = 2 -deoxyguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = gm
  modified_base 21: mod_base = OTHER; note = 2'-O-propargyluridine
  modified_base 21^22: mod_base = OTHER; note = phosphorothioate linkage
  modified_base 22: mod_base = cm
  modified_base 22^23: mod_base = OTHER; note = phosphorothioate linkage
  modified_base 23: mod_base = um
  source 1..24: mol_type = other RNA
agttattctgggacgactggtact

SEQ ID NO: 440 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = gm
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = gm
  modified_base 14: mod_base = cm
  modified_base 15: mod_base = cm
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgcccatttg

SEQ ID NO: 441 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorodithioate linkage
  modified_base 21: mod_base = gm
  source 1..21: mol_type = other RNA
tgacaagaaagtgtccatttg

SEQ ID NO: 442 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = cm
  modified_base 20^21: mod_base = OTHER; note = phosphorodithioate linkage
  modified_base 21: mod_base = gm
  source 1..21: mol_type = other RNA
tgacaagaaagtgtccattcg

SEQ ID NO: 443 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tgttaagaaagtataagccag

SEQ ID NO: 444 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaaggaagtataagccag

SEQ ID NO: 445 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-O-methyladenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-O-methyladenosine
  modified_base 11: mod_base = OTHER; note = 2'-fluoroguanosine
  modified_base 12: mod_base = OTHER; note = 2'-fluorouridine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 446 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = um
  modified_base 20: mod_base = um
  modified_base 20^21: mod_base = OTHER; note = phosphorothioate linkage
  modified_base 21: mod_base = gm
  source 1..21: mol_type = other RNA
tgacaagaaagtgcccatttg

SEQ ID NO: 447 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-fluoroadenosine
  modified_base 6: mod_base = OTHER; note = 2'-O-methyladenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 448 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = OTHER; note = 2'-O-methyladenosine
  modified_base 8: mod_base = gm
  modified_base 9: mod_base = cm
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroadenosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = gm
  modified_base 18: mod_base = OTHER; note = 2'-fluorocytidine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tcctcaagcaaagagtgccag

SEQ ID NO: 449 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroguanosine
  modified_base 5: mod_base = gm
  modified_base 6: mod_base = OTHER; note = 2'-fluoroadenosine
  modified_base 7: mod_base = OTHER; note = 2'-O-methyladenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
atcggaagatcctcaagcaaa

SEQ ID NO: 450 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = um
  modified_base 8: mod_base = gm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = gm
  modified_base 18: mod_base = OTHER; note = 2'-fluoroguanosine
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tctagttgcagtttcaggaca

SEQ ID NO: 451 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroguanosine
  modified_base 7: mod_base = um
  modified_base 8: mod_base = um
  modified_base 9: mod_base = gm
  modified_base 10: mod_base = cm
  modified_base 11: mod_base = OTHER; note = 2'-O-methyladenosine
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = OTHER; note = 2'-O-methyladenosine
  modified_base 20^21: mod_base = OTHER; note = phosphorothioate linkage
  modified_base 21: mod_base = cm
  source 1..21: mol_type = other RNA
ttctagttgcagtttcaggac

SEQ ID NO: 452 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = um
  modified_base 8: mod_base = OTHER; note = 2'-O-methyladenosine
  modified_base 9: mod_base = OTHER; note = 2'-O-methyladenosine
  modified_base 10: mod_base = gm
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = gm
  modified_base 18: mod_base = OTHER; note = 2'-fluoroadenosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = gm
  source 1..21: mol_type = other RNA
tgatcttaagctctaggaagg

SEQ ID NO: 453 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluoroguanosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluorocytidine
  modified_base 19: mod_base = cm
  modified_base 20: mod_base = cm
  modified_base 20^21: mod_base = OTHER; note = phosphorothioate linkage
  modified_base 21: mod_base = cm
  source 1..21: mol_type = other RNA
tagtaattcagctggtacccc

SEQ ID NO: 454 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 455 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = gm
  modified_base 8: mod_base = gm
  modified_base 9: mod_base = OTHER; note = 2'-O-methyladenosine
  modified_base 10: mod_base = OTHER; note = 2'-O-methyladenosine
  modified_base 11: mod_base = OTHER; note = 2'-O-methyladenosine
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroguanosine
  modified_base 15: mod_base = gm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
tagaatggaaagaggcagcaa

SEQ ID NO: 456 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = um
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = OTHER; note = 2'-fluoroguanosine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttatgatccaggtagaggaga

SEQ ID NO: 457 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-fluoroadenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 458 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = cm
  modified_base 8: mod_base = cm
  modified_base 9: mod_base = OTHER; note = 2'-O-methyladenosine
  modified_base 10: mod_base = cm
  modified_base 11: mod_base = OTHER; note = 2'-O-methyladenosine
  modified_base 12: mod_base = OTHER; note = 2'-fluorouridine
  modified_base 13: mod_base = um
  modified_base 14: mod_base = OTHER; note = 2'-fluoroguanosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorouridine
  modified_base 19: mod_base = um
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
tcttgaccacattgccattat

SEQ ID NO: 459 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorocytidine
  modified_base 7: mod_base = um
  modified_base 8: mod_base = gm
  modified_base 9: mod_base = OTHER; note = 2'-O-methyladenosine
  modified_base 10: mod_base = um
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tgaatctgatgcctccagtca

SEQ ID NO: 460 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-O-methyladenosine
  modified_base 9: mod_base = um
  modified_base 10: mod_base = um
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroguanosine
  modified_base 19: mod_base = gm
  modified_base 20: mod_base = um
  modified_base 20^21: mod_base = OTHER; note = phosphorothioate linkage
  modified_base 21: mod_base = um
  source 1..21: mol_type = other RNA
tagtcatattgccaggtggtt

SEQ ID NO: 461 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroguanosine
  modified_base 7: mod_base = gm
  modified_base 8: mod_base = gm
  modified_base 9: mod_base = gm
  modified_base 10: mod_base = um
  modified_base 11: mod_base = cm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluoroguanosine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = cm
  modified_base 20^21: mod_base = OTHER; note = phosphorothioate linkage
  modified_base 21: mod_base = OTHER; note = 2'-O-methyladenosine
  source 1..21: mol_type = other RNA
tcataggggtcaagtgagtca

SEQ ID NO: 462 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-O-methyladenosine
  modified_base 9: mod_base = gm
  modified_base 10: mod_base = um
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = gm
  modified_base 20: mod_base = gm
  modified_base 20^21: mod_base = OTHER; note = phosphorothioate linkage
  modified_base 21: mod_base = gm
  source 1..21: mol_type = other RNA
acaagaaagtgcccatttggg

SEQ ID NO: 463 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorouridine
  modified_base 19: mod_base = gm
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
taacacatcagccaacctgga

SEQ ID NO: 464 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroadenosine
  modified_base 7: mod_base = cm
  modified_base 8: mod_base = cm
  modified_base 9: mod_base = cm
  modified_base 10: mod_base = um
  modified_base 11: mod_base = gm
  modified_base 12: mod_base = OTHER; note = 2'-fluorocytidine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = OTHER; note = 2'-O-methyladenosine
  modified_base 18: mod_base = OTHER; note = 2'-fluoroguanosine
  modified_base 19: mod_base = cm
  modified_base 20: mod_base = cm
  modified_base 20^21: mod_base = OTHER; note = phosphorothioate linkage
  modified_base 21: mod_base = um
  source 1..21: mol_type = other RNA
tgcttaccctgcttcaagcct

SEQ ID NO: 465 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluorouridine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroadenosine
  modified_base 19: mod_base = gm
  modified_base 20: mod_base = cm
  modified_base 20^21: mod_base = OTHER; note = phosphorothioate linkage
  modified_base 21: mod_base = cm
  source 1..21: mol_type = other RNA
ttgcttaccctgcttcaagcc

SEQ ID NO: 466 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = um
  modified_base 8: mod_base = cm
  modified_base 9: mod_base = um
  modified_base 10: mod_base = um
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = gm
  modified_base 20^21: mod_base = OTHER; note = phosphorothioate linkage
  modified_base 21: mod_base = cm
  source 1..21: mol_type = other RNA
tgaacttcttaggcttagtgc

SEQ ID NO: 467 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluoroadenosine
  modified_base 7: mod_base = gm
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = OTHER; note = 2'-fluorocytidine
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 468 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroguanosine
  modified_base 6: mod_base = um
  modified_base 7: mod_base = OTHER; note = 2'-O-methyladenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 469 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 470 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = cm
  modified_base 12: mod_base = OTHER; note = 2'-O-methyladenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 471 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroguanosine
  modified_base 6: mod_base = um
  modified_base 7: mod_base = OTHER; note = 2',3'-seco-adenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = cm
  modified_base 12: mod_base = OTHER; note = 2'-O-methyladenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..24: mol_type = other RNA
tgcagtatnaattcagctggtacc

SEQ ID NO: 472 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroguanosine
  modified_base 6: mod_base = um
  modified_base 7: mod_base = OTHER; note = 2',3'-seco-adenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..24: mol_type = other RNA
tgcagtatnaattcagctggtacc

SEQ ID NO: 473 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 474 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 475 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = OTHER; note = 2'-fluoroadenosine
  modified_base 8: mod_base = OTHER; note = 2'-O-methyladenosine
  modified_base 9: mod_base = um
  modified_base 10: mod_base = um
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = gm
  modified_base 18: mod_base = um
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tgcagtaattcagctggtacc

SEQ ID NO: 476 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluorocytidine
  modified_base 6: mod_base = cm
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 477 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 478 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-fluoroadenosine
  modified_base 10: mod_base = um
  modified_base 11: mod_base = um
  modified_base 12: mod_base = gm
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 479 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluorocytidine
  modified_base 6: mod_base = cm
  modified_base 7: mod_base = OTHER; note = 2',3'-seco-adenosine
  modified_base 8: mod_base = cm
  modified_base 9: mod_base = OTHER; note = 2'-fluoroadenosine
  modified_base 10: mod_base = um
  modified_base 11: mod_base = um
  modified_base 12: mod_base = gm
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..24: mol_type = other RNA
ttgaccatnacattgccattatga

SEQ ID NO: 480 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluorocytidine
  modified_base 6: mod_base = cm
  modified_base 7: mod_base = OTHER; note = 2',3'-seco-adenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..24: mol_type = other RNA
ttgaccatnacattgccattatga

SEQ ID NO: 481 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 482 - RNA, 21 nt, synthetic construct
  modified_base 1: mod_base = OTHER; note = 2'-deoxythymidine
  modified_base 1^2: mod_base = OTHER; note = phosphorodithioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 483 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 484 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorodithioate linkage
  modified_base 21: mod_base = OTHER; note = 2'-O-methyladenosine
  source 1..21: mol_type = other RNA
ttgaccacattgccattatga

SEQ ID NO: 485 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2 -deoxyadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttgaccacattgccattatga

SEQ ID NO: 486 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2',3'-seco-adenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = OTHER; note = 2'-O-methyladenosine
  source 1..24: mol_type = other RNA
ttgaccatnacattgccattatga

SEQ ID NO: 487 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = um
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = um
  modified_base 18: mod_base = OTHER; note = 2'-O-methyladenosine
  modified_base 19: mod_base = um
  modified_base 20: mod_base = gm
  modified_base 20^21: mod_base = OTHER; note = phosphorothioate linkage
  modified_base 21: mod_base = um
  source 1..21: mol_type = other RNA
ttgaccacattgccattatgt

SEQ ID NO: 488 - RNA, 23 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2 -deoxyguanosine
  modified_base 2^3: mod_base = OTHER; note = phosphorothioate linkage
  modified_base 3: mod_base = um
  modified_base 4: mod_base = um
  modified_base 5: mod_base = OTHER; note = 2 -deoxyadenosine
  modified_base 6: mod_base = um
  modified_base 7: mod_base = OTHER; note = 2'-deoxythymidine
  modified_base 8: mod_base = cm
  modified_base 9: mod_base = um
  modified_base 10: mod_base = gm
  modified_base 11: mod_base = gm
  modified_base 12: mod_base = OTHER; note = 2 -deoxyguanosine
  modified_base 13: mod_base = OTHER; note = 2'-O-methyladenosine
  modified_base 14: mod_base = OTHER; note = 2'-fluorocytidine
  modified_base 15: mod_base = gm
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = gm
  modified_base 21: mod_base = um
  modified_base 21^22: mod_base = OTHER; note = phosphorothioate linkage
  modified_base 22: mod_base = cm
  modified_base 22^23: mod_base = OTHER; note = phosphorothioate linkage
  modified_base 23: mod_base = um
  source 1..23: mol_type = other RNA
agttattctgggacgactggtct

SEQ ID NO: 489 - RNA, 26 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2 -deoxyadenosine
  modified_base 6: mod_base = gm
  modified_base 7: mod_base = OTHER; note = 2',3'-seco-uridine
  modified_base 8: mod_base = gm
  modified_base 9: mod_base = gm
  modified_base 10: mod_base = OTHER; note = 2'-O-methyladenosine
  modified_base 11: mod_base = gm
  modified_base 12: mod_base = um
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = gm
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = gm
  modified_base 21^22: mod_base = OTHER; note = phosphorothioate linkage
  modified_base 22: mod_base = um
  modified_base 22^23: mod_base = OTHER; note = phosphorothioate linkage
  modified_base 23: mod_base = OTHER; note = 2'-O-methyladenosine
  source 1..26: mol_type = other RNA
atgaagttnaggagtctgtgacagta

SEQ ID NO: 490 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
atcggaagatcctcaagcaaa

SEQ ID NO: 491 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorodithioate linkage
  modified_base 21: mod_base = OTHER; note = 2'-O-methyladenosine
  source 1..21: mol_type = other RNA
atcggaagatcctcaagcaaa

SEQ ID NO: 492 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = OTHER; note = 2'-O-methyladenosine
  source 1..21: mol_type = other RNA
ttcggaagatcctcaagcaaa

SEQ ID NO: 493 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
ttcggaagatcctcaagcaat

SEQ ID NO: 494 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluoroadenosine
  modified_base 8: mod_base = gm
  modified_base 9: mod_base = OTHER; note = 2'-O-methyladenosine
  modified_base 10: mod_base = um
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 20^21: mod_base = OTHER; note = phosphorothioate linkage
  modified_base 21: mod_base = um
  source 1..21: mol_type = other RNA
ttcggaagatcctcaagcaat

SEQ ID NO: 495 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttatgatccaggtagaggaga

SEQ ID NO: 496 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = OTHER; note = 2'-O-methyladenosine
  source 1..21: mol_type = other RNA
ttatgatccaggtagaggaga

SEQ ID NO: 497 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-deoxythymidine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2'-O-methyladenosine
  source 1..21: mol_type = other RNA
ttatgatccaggtagaggaga

SEQ ID NO: 498 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2',3'-seco-uridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = OTHER; note = 2'-O-methyladenosine
  source 1..24: mol_type = other RNA
ttatgattnaccaggtagaggaga

SEQ ID NO: 499 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = um
  source 1..21: mol_type = other RNA
ttatgatccaggtagaggagt

SEQ ID NO: 500 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = cm
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = gm
  modified_base 18: mod_base = gm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = um
  source 1..21: mol_type = other RNA
ttatgatccaggtagaggagt

SEQ ID NO: 501 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 502 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorodithioate linkage
  modified_base 21: mod_base = gm
  source 1..21: mol_type = other RNA
tattaagaaagtataagccag

SEQ ID NO: 503 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2 -deoxyguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 504 - RNA, 24 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2',3'-seco-guanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..24: mol_type = other RNA
tattaagtnaaaagtataagccag

SEQ ID NO: 505 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = um
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagtcag

SEQ ID NO: 506 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-O-methyladenosine
  modified_base 10: mod_base = OTHER; note = 2'-O-methyladenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = gm
  modified_base 18: mod_base = cm
  modified_base 19: mod_base = cm
  modified_base 20: mod_base = OTHER; note = 2'-O-methyladenosine
  modified_base 20^21: mod_base = OTHER; note = phosphorothioate linkage
  modified_base 21: mod_base = gm
  source 1..21: mol_type = other RNA
tattaagaaagtataagccag

SEQ ID NO: 507 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
accagtcgtcccagaataaca

SEQ ID NO: 508 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
accagtcgttccagaataaca

SEQ ID NO: 509 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
accagtcgtcccagaataata

SEQ ID NO: 510 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-fluoroadenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 511 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-fluoroadenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acataatggcaatgtggtcaa

SEQ ID NO: 512 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-O-methyladenosine
  modified_base 13: mod_base = OTHER; note = 2'-fluorouridine
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acataatggcaatgtggtcaa

SEQ ID NO: 513 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-cm
  modified_base 2: mod_base = um
  modified_base 3: mod_base = um
  modified_base 4: mod_base = um
  modified_base 5: mod_base = gm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ctttgctaccatcatagacaa

SEQ ID NO: 514 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
actcctctacctggatcataa

SEQ ID NO: 515 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaata

SEQ ID NO: 516 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
accagtcgtcctagaataaca

SEQ ID NO: 517 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-gm
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
gccagtcgtcccagaataaca

SEQ ID NO: 518 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-fluoroadenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = um-phosphorothioate-inverted (3'-3' linked) abasic deoxyribonucleotide
  source 1..21: mol_type = other RNA
attgcttgaggatcttccgat

SEQ ID NO: 519 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-fluoroadenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = um
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttctgaa

SEQ ID NO: 520 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2 -O-methyl-2-aminoadenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttanta

SEQ ID NO: 521 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2 -O-methyl-2-aminoadenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttnata

SEQ ID NO: 522 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = cm
  modified_base 4: mod_base = cm
  modified_base 5: mod_base = OTHER; note = 2'-O-methyladenosine
  modified_base 6: mod_base = cm
  modified_base 7: mod_base = um
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = cm
  modified_base 14: mod_base = um
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2 -O-methylinosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctccacttcagcctacancta

SEQ ID NO: 523 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = um
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = um
  modified_base 14: mod_base = gm
  modified_base 15: mod_base = OTHER; note = 2'-O-methyladenosine
  modified_base 16: mod_base = gm
  modified_base 17: mod_base = OTHER; note = 2 -O-methylinosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
gcactctttgcttgagnatca

SEQ ID NO: 524 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = gm
  modified_base 3: mod_base = cm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = cm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = cm
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
agcaccacatcaccaacctga

SEQ ID NO: 525 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = cm
  modified_base 4: mod_base = um
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = cm
  modified_base 19: mod_base = OTHER; note = 2 -O-methylinosine
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acctagagcttaagatccnaa

SEQ ID NO: 526 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = gm
  modified_base 3: mod_base = cm
  modified_base 4: mod_base = um
  modified_base 5: mod_base = gm
  modified_base 6: mod_base = cm
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = cm
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
agctgcctctttccattctga

SEQ ID NO: 527 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = OTHER; note = 2'-O-methyladenosine
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ggagtgaagagaccaagatga

SEQ ID NO: 528 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = cm
  modified_base 3: mod_base = um
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorouridine
  modified_base 12: mod_base = gm
  modified_base 13: mod_base = OTHER; note = 2'-O-methyladenosine
  modified_base 14: mod_base = cm
  modified_base 15: mod_base = um
  modified_base 16: mod_base = cm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cctggcaatatgactcactta

SEQ ID NO: 529 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = gm
  modified_base 14: mod_base = cm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ggacccaaatgggcactttca

SEQ ID NO: 530 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
caaatgggcactttcttgtca

SEQ ID NO: 531 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = OTHER; note = 2'-O-methyladenosine
  modified_base 3: mod_base = gm
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
gaggaggaagcagatagatga

SEQ ID NO: 532 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = um
  modified_base 20: mod_base = OTHER; note = 2 -O-methyl-2-aminoadenosine
  modified_base 21: mod_base = OTHER; note = 2'-O-methyladenosine-phosphorothioate-inverted (3'-3' linked) abasic deoxyribonucleotide
  source 1..21: mol_type = other RNA
cactgggagacaagcatttna

SEQ ID NO: 533 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = gm
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
gggagacaagcatttatacta

SEQ ID NO: 534 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = um
  modified_base 14: mod_base = um
  modified_base 15: mod_base = OTHER; note = 2'-O-methyladenosine
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ggagacaagcatttatactta

SEQ ID NO: 535 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = gm
  modified_base 3: mod_base = cm
  modified_base 4: mod_base = cm
  modified_base 5: mod_base = um
  modified_base 6: mod_base = gm
  modified_base 7: mod_base = gm
  modified_base 8: mod_base = cm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = um
  modified_base 13: mod_base = OTHER; note = 2'-O-methyladenosine
  modified_base 14: mod_base = cm
  modified_base 15: mod_base = um
  modified_base 16: mod_base = um
  modified_base 17: mod_base = um
  modified_base 18: mod_base = cm
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
cgcctggcttatactttctta

SEQ ID NO: 536 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = cm
  modified_base 3: mod_base = cm
  modified_base 4: mod_base = um
  modified_base 5: mod_base = gm
  modified_base 6: mod_base = gm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gcctggcttatactttcttaa

SEQ ID NO: 537 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide-NH-C6
  source 1..21: mol_type = other RNA
ctggcttatactttcttaata

SEQ ID NO: 538 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
caaatgggcactttcttgtca

SEQ ID NO: 539 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
caaatgggcactttcttgtta

SEQ ID NO: 540 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = um
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
caaatgggcacttttttgtca

SEQ ID NO: 541 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2 -O-methylinosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
caaatgggcactttcttntca

SEQ ID NO: 542 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2 -O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
cnaatgggcactttcttgtca

SEQ ID NO: 543 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2 -O-methyl-2-aminoadenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
canatgggcactttcttgtca

SEQ ID NO: 544 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2 -O-methyl-2-aminoadenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
caantgggcactttcttgtca

SEQ ID NO: 545 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluoroadenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = um
  modified_base 20: mod_base = OTHER; note = 2 -O-methyl-2-aminoadenosine
  modified_base 21: mod_base = OTHER; note = 2'-O-methyladenosine-phosphorothioate-inverted (3'-3' linked) abasic deoxyribonucleotide
  source 1..21: mol_type = other RNA
cactgggagacaagcatttna

SEQ ID NO: 546 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2 -O-methyl-2-aminoadenosine
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = um
  modified_base 20: mod_base = OTHER; note = 2 -O-methyl-2-aminoadenosine
  modified_base 21: mod_base = OTHER; note = 2'-O-methyladenosine-phosphorothioate-inverted (3'-3' linked) abasic deoxyribonucleotide
  source 1..21: mol_type = other RNA
cnctgggagacaagcatttna

SEQ ID NO: 547 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = OTHER; note = 2 -O-methylinosine
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = um
  modified_base 20: mod_base = OTHER; note = 2 -O-methyl-2-aminoadenosine
  modified_base 21: mod_base = OTHER; note = 2'-O-methyladenosine-phosphorothioate-inverted (3'-3' linked) abasic deoxyribonucleotide
  source 1..21: mol_type = other RNA
cactgngagacaagcatttna

SEQ ID NO: 548 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
cactgggagacaagcatttaa

SEQ ID NO: 549 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = cm
  modified_base 16: mod_base = OTHER; note = 2 -O-methyl-2-aminoadenosine
  modified_base 17: mod_base = um
  modified_base 18: mod_base = um
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
cactgggagacaagcntttaa

SEQ ID NO: 550 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
cagatgggcactttcttgtca

SEQ ID NO: 551 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
cgaatgggcactttcttgtca

SEQ ID NO: 552 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-sinverted (3'-3' linked) abasic deoxyribonucleotide-5'-phosphorothioate-hexyl-1-amine
  source 1..21: mol_type = other RNA
ctggcttatactttcttaata

SEQ ID NO: 553 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-fluoroadenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-sinverted (3'-3' linked) abasic deoxyribonucleotide-5'-phosphorothioate-hexyl-1-amine
  source 1..21: mol_type = other RNA
attgcttgaggatcttccgaa

SEQ ID NO: 554 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = OTHER; note = 2'-O-methyladenosine
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-sinverted (3'-3' linked) abasic deoxyribonucleotide-5'-phosphorothioate-hexyl-1-amine
  source 1..21: mol_type = other RNA
caaatgggcactttcttgtca

SEQ ID NO: 555 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = um-sinverted (3'-3' linked) abasic deoxyribonucleotide-5'-phosphorothioate-hexyl-1-amine
  source 1..21: mol_type = other RNA
accagtcgtcccagaataact

SEQ ID NO: 556 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = gm
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
cgaatgggcactttcttgtca

SEQ ID NO: 557 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaaca

SEQ ID NO: 558 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = OTHER; note = 2'-fluorouridine
  modified_base 13: mod_base = um
  modified_base 14: mod_base = cm
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatacttccttaata

SEQ ID NO: 559 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = cm
  modified_base 15: mod_base = um
  modified_base 16: mod_base = um
  modified_base 17: mod_base = gm
  modified_base 18: mod_base = OTHER; note = 2'-O-methyladenosine
  modified_base 19: mod_base = gm
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ctggcactctttgcttgagga

SEQ ID NO: 560 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = um-phosphorothioate-inverted (3'-3' linked) abasic deoxyribonucleotide
  source 1..21: mol_type = other RNA
tttgcttgaggatcttccgat

SEQ ID NO: 561 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = gm
  modified_base 3: mod_base = um
  modified_base 4: mod_base = cm
  modified_base 5: mod_base = cm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tgtcctgaaactgcaactaga

SEQ ID NO: 562 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = um
  modified_base 3: mod_base = cm
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = gm
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = cm
  modified_base 17: mod_base = um
  modified_base 18: mod_base = OTHER; note = 2'-O-methyladenosine
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
gtcctgaaactgcaactagaa

SEQ ID NO: 563 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = cm
  modified_base 3: mod_base = um
  modified_base 4: mod_base = um
  modified_base 5: mod_base = cm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ccttcctagagcttaagatca

SEQ ID NO: 564 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = gm
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = um
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ggggtaccagctgaattacta

SEQ ID NO: 565 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ggtaccagctgaattactgca

SEQ ID NO: 566 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = gm
  modified_base 4: mod_base = cm
  modified_base 5: mod_base = um
  modified_base 6: mod_base = gm
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = um
  modified_base 14: mod_base = cm
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ttgctgcctctttccattcta

SEQ ID NO: 567 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tctcctctacctggatcataa

SEQ ID NO: 568 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcataatggcaatgtggtcaa

SEQ ID NO: 569 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = cm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorouridine
  modified_base 12: mod_base = gm
  modified_base 13: mod_base = um
  modified_base 14: mod_base = gm
  modified_base 15: mod_base = gm
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
ataatggcaatgtggtcaaga

SEQ ID NO: 570 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
tgactggaggcatcagattca

SEQ ID NO: 571 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = OTHER; note = 2'-O-methyladenosine
  modified_base 3: mod_base = cm
  modified_base 4: mod_base = cm
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = cm
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
aaccacctggcaatatgacta

SEQ ID NO: 572 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = OTHER; note = 2'-O-methyladenosine
  modified_base 8: mod_base = cm
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = cm
  modified_base 14: mod_base = cm
  modified_base 15: mod_base = cm
  modified_base 16: mod_base = cm
  modified_base 17: mod_base = um
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine-phosphorothioate-inverted (3'-3' linked) abasic deoxyribonucleotide
  source 1..21: mol_type = other RNA
tgactcacttgacccctatga

SEQ ID NO: 573 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = um
  modified_base 20: mod_base = gm
  modified_base 21: mod_base = OTHER; note = um-phosphorothioate-inverted (3'-3' linked) abasic deoxyribonucleotide
  source 1..21: mol_type = other RNA
cccaaatgggcactttcttgt

SEQ ID NO: 574 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = gm
  modified_base 19: mod_base = um
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
tccaggttggctgatgtgtta

SEQ ID NO: 575 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = gm
  modified_base 3: mod_base = gm
  modified_base 4: mod_base = cm
  modified_base 5: mod_base = um
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = gm
  modified_base 15: mod_base = gm
  modified_base 16: mod_base = um
  modified_base 17: mod_base = OTHER; note = 2'-O-methyladenosine
  modified_base 18: mod_base = OTHER; note = 2'-O-methyladenosine
  modified_base 19: mod_base = gm
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
aggcttgaagcagggtaagca

SEQ ID NO: 576 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = cm
  modified_base 4: mod_base = um
  modified_base 5: mod_base = um
  modified_base 6: mod_base = gm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = gm
  modified_base 13: mod_base = gm
  modified_base 14: mod_base = gm
  modified_base 15: mod_base = um
  modified_base 16: mod_base = OTHER; note = 2'-O-methyladenosine
  modified_base 17: mod_base = OTHER; note = 2'-O-methyladenosine
  modified_base 18: mod_base = gm
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
ggcttgaagcagggtaagcaa

SEQ ID NO: 577 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = cm
  modified_base 3: mod_base = OTHER; note = 2'-O-methyladenosine
  modified_base 4: mod_base = cm
  modified_base 5: mod_base = um
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = gm
  modified_base 18: mod_base = um
  modified_base 19: mod_base = um
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
gcactaagcctaagaagttca

SEQ ID NO: 578 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaata

SEQ ID NO: 579 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ggtaccagctgaattactgca

SEQ ID NO: 580 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-fluoroadenosine
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ggtaccagctgaattactgca

SEQ ID NO: 581 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-fluoroadenosine
  modified_base 8: mod_base = gm
  modified_base 9: mod_base = OTHER; note = 2'-fluorocytidine
  modified_base 10: mod_base = um
  modified_base 11: mod_base = OTHER; note = 2'-fluoroguanosine
  modified_base 12: mod_base = OTHER; note = 2'-O-methyladenosine
  modified_base 13: mod_base = OTHER; note = 2'-O-methyladenosine
  modified_base 14: mod_base = um
  modified_base 15: mod_base = um
  modified_base 16: mod_base = OTHER; note = 2'-O-methyladenosine
  modified_base 17: mod_base = cm
  modified_base 18: mod_base = um
  modified_base 19: mod_base = gm
  modified_base 20: mod_base = cm
  modified_base 21: mod_base = OTHER; note = 2'-O-methyladenosine-phosphorothioate-inverted (3'-3' linked) abasic deoxyribonucleotide
  source 1..21: mol_type = other RNA
ggtaccagctgaattactgca

SEQ ID NO: 582 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcataatggcaatgtggtcaa

SEQ ID NO: 583 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-fluoroadenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcataatggcaatgtggtcaa

SEQ ID NO: 584 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcataatggcaatgtggtcaa

SEQ ID NO: 585 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acataatggcaatgtggtcaa

SEQ ID NO: 586 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acataatggcaatgtggtcaa

SEQ ID NO: 587 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluorouridine
  modified_base 8: mod_base = gm
  modified_base 9: mod_base = OTHER; note = 2'-fluoroguanosine
  modified_base 10: mod_base = cm
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
acataatggcaatgtggtcaa

SEQ ID NO: 588 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-um
  modified_base 1^2: mod_base = OTHER; note = phosphorothioate linkage
  modified_base 2: mod_base = cm
  modified_base 3: mod_base = OTHER; note = 2'-O-methyladenosine
  modified_base 4: mod_base = um
  modified_base 5: mod_base = OTHER; note = 2'-O-methyladenosine
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = gm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tcataatggcaatgtggtcaa

SEQ ID NO: 589 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = cm
  modified_base 4: mod_base = OTHER; note = 2'-O-methyladenosine
  modified_base 5: mod_base = gm
  modified_base 6: mod_base = um
  modified_base 7: mod_base = cm
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = OTHER; note = 2'-O-methyladenosine
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = um-phosphorothioate-inverted (3'-3' linked) abasic deoxyribonucleotide
  source 1..21: mol_type = other RNA
accagtcgtcccagaataact

SEQ ID NO: 590 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-cm
  modified_base 1^2: mod_base = OTHER; note = phosphorothioate linkage
  modified_base 2: mod_base = um
  modified_base 3: mod_base = gm
  modified_base 4: mod_base = um
  modified_base 5: mod_base = cm
  modified_base 6: mod_base = OTHER; note = 2'-O-methyladenosine
  modified_base 7: mod_base = OTHER; note = 2'-fluorocytidine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = cm
  modified_base 14: mod_base = cm
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = cm
  modified_base 20: mod_base = OTHER; note = 2'-O-methyladenosine
  modified_base 21: mod_base = OTHER; note = um-phosphorothioate-inverted (3'-3' linked) abasic deoxyribonucleotide
  source 1..21: mol_type = other RNA
ctgtcacagactccacttcat

SEQ ID NO: 591 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = um-phosphorothioate-inverted (3'-3' linked) abasic deoxyribonucleotide
  source 1..21: mol_type = other RNA
tttgcttgaggatcttccgat

SEQ ID NO: 592 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = OTHER; note = 2'-fluorouridine
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = um-phosphorothioate-inverted (3'-3' linked) abasic deoxyribonucleotide
  source 1..21: mol_type = other RNA
tttgcttgaggatcttccgat

SEQ ID NO: 593 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tttgcttgaggatcttccgaa

SEQ ID NO: 594 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 595 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = OTHER; note = 2'-fluorouridine
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tttgcttgaggatcttccgaa

SEQ ID NO: 596 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = OTHER; note = 2'-fluorouridine
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 597 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 598 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 599 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = um
  modified_base 3: mod_base = um
  modified_base 4: mod_base = gm
  modified_base 5: mod_base = cm
  modified_base 6: mod_base = um
  modified_base 7: mod_base = um
  modified_base 8: mod_base = gm
  modified_base 9: mod_base = OTHER; note = 2'-fluoroadenosine
  modified_base 10: mod_base = gm
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = um
  modified_base 17: mod_base = cm
  modified_base 18: mod_base = cm
  modified_base 19: mod_base = gm
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
attgcttgaggatcttccgaa

SEQ ID NO: 600 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tctcctctacctggatcataa

SEQ ID NO: 601 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-um
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = OTHER; note = 2'-fluorocytidine
  modified_base 8: mod_base = um
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
tctcctctacctggatcataa

SEQ ID NO: 602 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-2'-O-methyladenosin e
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
actcctctacctggatcataa

SEQ ID NO: 603 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
actcctctacctggatcataa

SEQ ID NO: 604 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
actcctctacctggatcataa

SEQ ID NO: 605 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-2'-O-methyladenosine
  modified_base 1^2: mod_base = OTHER; note = phosphorothioate linkage
  modified_base 2: mod_base = cm
  modified_base 3: mod_base = um
  modified_base 4: mod_base = cm
  modified_base 5: mod_base = cm
  modified_base 6: mod_base = um
  modified_base 7: mod_base = OTHER; note = 2'-fluorocytidine
  modified_base 8: mod_base = um
  modified_base 9: mod_base = OTHER; note = 2'-fluoroadenosine
  modified_base 10: mod_base = cm
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = um
  modified_base 20: mod_base = OTHER; note = 2'-O-methyladenosine
  modified_base 21: mod_base = OTHER; note = 2'-O-methyladenosine-phosphorothioate-inverted (3'-3' linked) abasic deoxyribonucleotide
  source 1..21: mol_type = other RNA
actcctctacctggatcataa

SEQ ID NO: 606 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaata

SEQ ID NO: 607 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-inverted (3'-3' linked) abasic deoxyribonucleotide-5'-phosphorothioate-cm
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = OTHER; note = 2'-fluorouridine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaata

SEQ ID NO: 608 - RNA, 21 nt, synthetic construct
  modified_base 1: mod_base = OTHER; note 4-((1,22-bis(((2R,3R,4R,5R,6R)-3-acetamido-4,5-diacetoxy-6- (acetoxymethyl)tetrahydro-2H-pyran-2-yl)oxy)-10-((2-(2-(((2 R,3R,4R,5R,6R)-3-acetamido-4,5-diacetoxy-6-(acetoxymethyl)t etrahydro-2H-pyran-2-yl)oxy)ethoxy)ethyl)carbamoyl)-7,12,16 -trioxo-3,20-dioxa-6,11,17-triazadocosan-15-yl)carbamoyl)cy clohexyl phosphorothioate-cm
  modified_base 1^2: mod_base = OTHER; note = phosphorothioate linkage
  modified_base 2: mod_base = um
  modified_base 3: mod_base = gm
  modified_base 4: mod_base = gm
  modified_base 5: mod_base = cm
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-O-methyladenosine
  modified_base 11: mod_base = OTHER; note = 2'-fluorocytidine
  modified_base 12: mod_base = um
  modified_base 13: mod_base = um
  modified_base 14: mod_base = um
  modified_base 15: mod_base = cm
  modified_base 16: mod_base = um
  modified_base 17: mod_base = um
  modified_base 18: mod_base = OTHER; note = 2'-O-methyladenosine
  modified_base 19: mod_base = OTHER; note = 2'-O-methyladenosine
  modified_base 20: mod_base = um
  modified_base 21: mod_base = OTHER; note = 2'-O-methyladenosine-phosphorothioate-inverted (3'-3' linked) abasic deoxyribonucleotide
  source 1..21: mol_type = other RNA
ctggcttatactttcttaata

SEQ ID NO: 609 - RNA, 21 nt, synthetic construct
  source 1..21: mol_type = other RNA
agttattctgggacgactggt

SEQ ID NO: 610 - RNA, 21 nt, synthetic construct
  source 1..21: mol_type = other RNA
tgttattctgggacgactggt

SEQ ID NO: 611 - RNA, 21 nt, synthetic construct
  source 1..21: mol_type = other RNA
tgttattttgggacgactggt

SEQ ID NO: 612 - RNA, 21 nt, synthetic construct
  source 1..21: mol_type = other RNA
tgttattctgggatgactggt

SEQ ID NO: 613 - RNA, 21 nt, synthetic construct
  source 1..21: mol_type = other RNA
tgttattctgggacgattggt

SEQ ID NO: 614 - RNA, 21 nt, synthetic construct
  source 1..21: mol_type = other RNA
tgttattctgggatgattggt

SEQ ID NO: 615 - RNA, 21 nt, synthetic construct
  source 1..21: mol_type = other RNA
tgttattttgggacgattggt

SEQ ID NO: 616 - RNA, 21 nt, synthetic construct
  source 1..21: mol_type = other RNA
ttcggaagatcctcaagcaaa

SEQ ID NO: 617 - RNA, 21 nt, synthetic construct
  source 1..21: mol_type = other RNA
ttcggaagatcctcaagcaat

SEQ ID NO: 618 - RNA, 21 nt, synthetic construct
  source 1..21: mol_type = other RNA
ttgaccacattgccattatgt

SEQ ID NO: 619 - RNA, 21 nt, synthetic construct
  source 1..21: mol_type = other RNA
ttgtctatgatggtagcaaag

SEQ ID NO: 620 - RNA, 21 nt, synthetic construct
  source 1..21: mol_type = other RNA
ttatgatccaggtagaggagt

SEQ ID NO: 621 - RNA, 21 nt, synthetic construct
  source 1..21: mol_type = other RNA
tattaagaaagtataagccag

SEQ ID NO: 622 - RNA, 21 nt, synthetic construct
  modified_base 1: mod_base = i
  source 1..21: mol_type = other RNA
ngttattctgggatgactggt

SEQ ID NO: 623 - RNA, 21 nt, synthetic construct
  source 1..21: mol_type = other RNA
tgttattctgggatgactggc

SEQ ID NO: 624 - RNA, 21 nt, synthetic construct
  modified_base 21: mod_base = i
  source 1..21: mol_type = other RNA
ttgaccacattgccattatgn

SEQ ID NO: 625 - RNA, 21 nt, synthetic construct
  modified_base 21: mod_base = i
  source 1..21: mol_type = other RNA
ttatgatccaggtagaggagn

SEQ ID NO: 626 - RNA, 21 nt, synthetic construct
  modified_base 1: mod_base = i
  source 1..21: mol_type = other RNA
ngttattctgggacgactggt

SEQ ID NO: 627 - RNA, 21 nt, synthetic construct
  modified_base 1: mod_base = i
  source 1..21: mol_type = other RNA
ntcggaagatcctcaagcaaa

SEQ ID NO: 628 - RNA, 21 nt, synthetic construct
  modified_base 21: mod_base = i
  source 1..21: mol_type = other RNA
atcggaagatcctcaagcaan

SEQ ID NO: 629 - RNA, 21 nt, synthetic construct
  modified_base 1: mod_base = i
  modified_base 21: mod_base = i
  source 1..21: mol_type = other RNA
ntcggaagatcctcaagcaan

SEQ ID NO: 630 - RNA, 21 nt, synthetic construct
  modified_base 1: mod_base = i
  source 1..21: mol_type = other RNA
ntcggaagatcctcaagcaat

SEQ ID NO: 631 - RNA, 21 nt, synthetic construct
  source 1..21: mol_type = other RNA
tttggaagatcctcaagcaat

SEQ ID NO: 632 - RNA, 21 nt, synthetic construct
  source 1..21: mol_type = other RNA
ttcggaagatccttaagcaat

SEQ ID NO: 633 - RNA, 21 nt, synthetic construct
  source 1..21: mol_type = other RNA
tagctgtaggctgaagtggag

SEQ ID NO: 634 - RNA, 21 nt, synthetic construct
  source 1..21: mol_type = other RNA
tgatcctcaagcaaagagtgc

SEQ ID NO: 635 - RNA, 21 nt, synthetic construct
  source 1..21: mol_type = other RNA
tcaggttggtgatgtggtgct

SEQ ID NO: 636 - RNA, 21 nt, synthetic construct
  source 1..21: mol_type = other RNA
ttcggatcttaagctctaggt

SEQ ID NO: 637 - RNA, 21 nt, synthetic construct
  source 1..21: mol_type = other RNA
tcagaatggaaagaggcagct

SEQ ID NO: 638 - RNA, 21 nt, synthetic construct
  source 1..21: mol_type = other RNA
tcatcttggtctcttcactcc

SEQ ID NO: 639 - RNA, 21 nt, synthetic construct
  source 1..21: mol_type = other RNA
taagtgagtcatattgccagg

SEQ ID NO: 640 - RNA, 21 nt, synthetic construct
  source 1..21: mol_type = other RNA
tgaaagtgcccatttgggtcc

SEQ ID NO: 641 - RNA, 21 nt, synthetic construct
  source 1..21: mol_type = other RNA
tgacaagaaagtgcccatttg

SEQ ID NO: 642 - RNA, 21 nt, synthetic construct
  source 1..21: mol_type = other RNA
tcatctatctgcttcctcctc

SEQ ID NO: 643 - RNA, 21 nt, synthetic construct
  source 1..21: mol_type = other RNA
ttaaatgcttgtctcccagtg

SEQ ID NO: 644 - RNA, 21 nt, synthetic construct
  source 1..21: mol_type = other RNA
tagtataaatgcttgtctccc

SEQ ID NO: 645 - RNA, 21 nt, synthetic construct
  source 1..21: mol_type = other RNA
taagtataaatgcttgtctcc

SEQ ID NO: 646 - RNA, 21 nt, synthetic construct
  source 1..21: mol_type = other RNA
taagaaagtataagccaggcg

SEQ ID NO: 647 - RNA, 21 nt, synthetic construct
  source 1..21: mol_type = other RNA
ttaagaaagtataagccaggc

SEQ ID NO: 648 - RNA, 21 nt, synthetic construct
  source 1..21: mol_type = other RNA
ttaaatgcttgtctctcagtg

SEQ ID NO: 649 - RNA, 21 nt, synthetic construct
  source 1..21: mol_type = other RNA
tgacaagaaagtgcccatctg

SEQ ID NO: 650 - RNA, 21 nt, synthetic construct
  source 1..21: mol_type = other RNA
tgacaagaaagtgcccattcg

SEQ ID NO: 651 - RNA, 23 nt, synthetic construct
  source 1..23: mol_type = other RNA
agttattctgggacgactggtct

SEQ ID NO: 652 - RNA, 21 nt, synthetic construct
  source 1..21: mol_type = other RNA
tgacaagaaagtgtccatttg

SEQ ID NO: 653 - RNA, 21 nt, synthetic construct
  source 1..21: mol_type = other RNA
tgacaagaaagtgtccattcg

SEQ ID NO: 654 - RNA, 21 nt, synthetic construct
  source 1..21: mol_type = other RNA
tgttaagaaagtataagccag

SEQ ID NO: 655 - RNA, 21 nt, synthetic construct
  source 1..21: mol_type = other RNA
tattaaggaagtataagccag

SEQ ID NO: 656 - RNA, 21 nt, synthetic construct
  source 1..21: mol_type = other RNA
tcctcaagcaaagagtgccag

SEQ ID NO: 657 - RNA, 21 nt, synthetic construct
  source 1..21: mol_type = other RNA
atcggaagatcctcaagcaaa

SEQ ID NO: 658 - RNA, 21 nt, synthetic construct
  source 1..21: mol_type = other RNA
tctagttgcagtttcaggaca

SEQ ID NO: 659 - RNA, 21 nt, synthetic construct
  source 1..21: mol_type = other RNA
ttctagttgcagtttcaggac

SEQ ID NO: 660 - RNA, 21 nt, synthetic construct
  source 1..21: mol_type = other RNA
tgatcttaagctctaggaagg

SEQ ID NO: 661 - RNA, 21 nt, synthetic construct
  source 1..21: mol_type = other RNA
tagtaattcagctggtacccc

SEQ ID NO: 662 - RNA, 21 nt, synthetic construct
  source 1..21: mol_type = other RNA
tgcagtaattcagctggtacc

SEQ ID NO: 663 - RNA, 21 nt, synthetic construct
  source 1..21: mol_type = other RNA
tagaatggaaagaggcagcaa

SEQ ID NO: 664 - RNA, 21 nt, synthetic construct
  source 1..21: mol_type = other RNA
ttatgatccaggtagaggaga

SEQ ID NO: 665 - RNA, 21 nt, synthetic construct
  source 1..21: mol_type = other RNA
ttgaccacattgccattatga

SEQ ID NO: 666 - RNA, 21 nt, synthetic construct
  source 1..21: mol_type = other RNA
tcttgaccacattgccattat

SEQ ID NO: 667 - RNA, 21 nt, synthetic construct
  source 1..21: mol_type = other RNA
tgaatctgatgcctccagtca

SEQ ID NO: 668 - RNA, 21 nt, synthetic construct
  source 1..21: mol_type = other RNA
tagtcatattgccaggtggtt

SEQ ID NO: 669 - RNA, 21 nt, synthetic construct
  source 1..21: mol_type = other RNA
tcataggggtcaagtgagtca

SEQ ID NO: 670 - RNA, 21 nt, synthetic construct
  source 1..21: mol_type = other RNA
acaagaaagtgcccatttggg

SEQ ID NO: 671 - RNA, 21 nt, synthetic construct
  source 1..21: mol_type = other RNA
taacacatcagccaacctgga

SEQ ID NO: 672 - RNA, 21 nt, synthetic construct
  source 1..21: mol_type = other RNA
tgcttaccctgcttcaagcct

SEQ ID NO: 673 - RNA, 21 nt, synthetic construct
  source 1..21: mol_type = other RNA
ttgcttaccctgcttcaagcc

SEQ ID NO: 674 - RNA, 21 nt, synthetic construct
  source 1..21: mol_type = other RNA
tgaacttcttaggcttagtgc

SEQ ID NO: 675 - RNA, 23 nt, synthetic construct
  source 1..23: mol_type = other RNA
atgaagtggagtctgtgacagta

SEQ ID NO: 676 - RNA, 21 nt, synthetic construct
  source 1..21: mol_type = other RNA
tattaagaaagtataagtcag

SEQ ID NO: 677 - RNA, 21 nt, synthetic construct
  source 1..21: mol_type = other RNA
accagtcgtcccagaataaca

SEQ ID NO: 678 - RNA, 21 nt, synthetic construct
  source 1..21: mol_type = other RNA
accagtcgttccagaataaca

SEQ ID NO: 679 - RNA, 21 nt, synthetic construct
  source 1..21: mol_type = other RNA
accagtcgtcccagaataata

SEQ ID NO: 680 - RNA, 21 nt, synthetic construct
  source 1..21: mol_type = other RNA
attgcttgaggatcttccgaa

SEQ ID NO: 681 - RNA, 21 nt, synthetic construct
  source 1..21: mol_type = other RNA
acataatggcaatgtggtcaa

SEQ ID NO: 682 - RNA, 21 nt, synthetic construct
  source 1..21: mol_type = other RNA
ctttgctaccatcatagacaa

SEQ ID NO: 683 - RNA, 21 nt, synthetic construct
  source 1..21: mol_type = other RNA
actcctctacctggatcataa

SEQ ID NO: 684 - RNA, 21 nt, synthetic construct
  source 1..21: mol_type = other RNA
ctggcttatactttcttaata

SEQ ID NO: 685 - RNA, 21 nt, synthetic construct
  source 1..21: mol_type = other RNA
accagtcgtcctagaataaca

SEQ ID NO: 686 - RNA, 21 nt, synthetic construct
  source 1..21: mol_type = other RNA
gccagtcgtcccagaataaca

SEQ ID NO: 687 - RNA, 21 nt, synthetic construct
  source 1..21: mol_type = other RNA
attgcttgaggatcttccgat

SEQ ID NO: 688 - RNA, 21 nt, synthetic construct
  source 1..21: mol_type = other RNA
attgcttgaggatcttctgaa

SEQ ID NO: 689 - RNA, 21 nt, synthetic construct
  modified_base 19: mod_base = OTHER; note = 2-aminoadenine nucleotide
  source 1..21: mol_type = other RNA
ctggcttatactttcttanta

SEQ ID NO: 690 - RNA, 21 nt, synthetic construct
  modified_base 18: mod_base = OTHER; note = 2-aminoadenine nucleotide
  source 1..21: mol_type = other RNA
ctggcttatactttcttnata

SEQ ID NO: 691 - RNA, 21 nt, synthetic construct
  modified_base 18: mod_base = i
  source 1..21: mol_type = other RNA
ctccacttcagcctacancta

SEQ ID NO: 692 - RNA, 21 nt, synthetic construct
  modified_base 17: mod_base = i
  source 1..21: mol_type = other RNA
gcactctttgcttgagnatca

SEQ ID NO: 693 - RNA, 21 nt, synthetic construct
  source 1..21: mol_type = other RNA
agcaccacatcaccaacctga

SEQ ID NO: 694 - RNA, 21 nt, synthetic construct
  modified_base 19: mod_base = i
  source 1..21: mol_type = other RNA
acctagagcttaagatccnaa

SEQ ID NO: 695 - RNA, 21 nt, synthetic construct
  source 1..21: mol_type = other RNA
agctgcctctttccattctga

SEQ ID NO: 696 - RNA, 21 nt, synthetic construct
  source 1..21: mol_type = other RNA
ggagtgaagagaccaagatga

SEQ ID NO: 697 - RNA, 21 nt, synthetic construct
  source 1..21: mol_type = other RNA
cctggcaatatgactcactta

SEQ ID NO: 698 - RNA, 21 nt, synthetic construct
  source 1..21: mol_type = other RNA
ggacccaaatgggcactttca

SEQ ID NO: 699 - RNA, 21 nt, synthetic construct
  source 1..21: mol_type = other RNA
caaatgggcactttcttgtca

SEQ ID NO: 700 - RNA, 21 nt, synthetic construct
  source 1..21: mol_type = other RNA
gaggaggaagcagatagatga

SEQ ID NO: 701 - RNA, 21 nt, synthetic construct
  modified_base 20: mod_base = OTHER; note = 2-aminoadenine nucleotide
  source 1..21: mol_type = other RNA
cactgggagacaagcatttna

SEQ ID NO: 702 - RNA, 21 nt, synthetic construct
  source 1..21: mol_type = other RNA
gggagacaagcatttatacta

SEQ ID NO: 703 - RNA, 21 nt, synthetic construct
  source 1..21: mol_type = other RNA
ggagacaagcatttatactta

SEQ ID NO: 704 - RNA, 21 nt, synthetic construct
  source 1..21: mol_type = other RNA
cgcctggcttatactttctta

SEQ ID NO: 705 - RNA, 21 nt, synthetic construct
  source 1..21: mol_type = other RNA
gcctggcttatactttcttaa

SEQ ID NO: 706 - RNA, 21 nt, synthetic construct
  source 1..21: mol_type = other RNA
caaatgggcactttcttgtta

SEQ ID NO: 707 - RNA, 21 nt, synthetic construct
  source 1..21: mol_type = other RNA
caaatgggcacttttttgtca

SEQ ID NO: 708 - RNA, 21 nt, synthetic construct
  modified_base 18: mod_base = i
  source 1..21: mol_type = other RNA
caaatgggcactttcttntca

SEQ ID NO: 709 - RNA, 21 nt, synthetic construct
  modified_base 2: mod_base = OTHER; note = 2-aminoadenine nucleotide
  source 1..21: mol_type = other RNA
cnaatgggcactttcttgtca

SEQ ID NO: 710 - RNA, 21 nt, synthetic construct
  modified_base 3: mod_base = OTHER; note = 2-aminoadenine nucleotide
  source 1..21: mol_type = other RNA
canatgggcactttcttgtca

SEQ ID NO: 711 - RNA, 21 nt, synthetic construct
  modified_base 4: mod_base = OTHER; note = 2-aminoadenine nucleotide
  source 1..21: mol_type = other RNA
caantgggcactttcttgtca

SEQ ID NO: 712 - RNA, 21 nt, synthetic construct
  modified_base 2: mod_base = OTHER; note = 2-aminoadenine nucleotide
  modified_base 20: mod_base = OTHER; note = 2-aminoadenine nucleotide
  source 1..21: mol_type = other RNA
cnctgggagacaagcatttna

SEQ ID NO: 713 - RNA, 21 nt, synthetic construct
  modified_base 6: mod_base = i
  modified_base 20: mod_base = OTHER; note = 2-aminoadenine nucleotide
  source 1..21: mol_type = other RNA
cactgngagacaagcatttna

SEQ ID NO: 714 - RNA, 21 nt, synthetic construct
  source 1..21: mol_type = other RNA
cactgggagacaagcatttaa

SEQ ID NO: 715 - RNA, 21 nt, synthetic construct
  modified_base 16: mod_base = OTHER; note = 2-aminoadenine nucleotide
  source 1..21: mol_type = other RNA
cactgggagacaagcntttaa

SEQ ID NO: 716 - RNA, 21 nt, synthetic construct
  source 1..21: mol_type = other RNA
cagatgggcactttcttgtca

SEQ ID NO: 717 - RNA, 21 nt, synthetic construct
  source 1..21: mol_type = other RNA
cgaatgggcactttcttgtca

SEQ ID NO: 718 - RNA, 21 nt, synthetic construct
  source 1..21: mol_type = other RNA
accagtcgtcccagaataact

SEQ ID NO: 719 - RNA, 21 nt, synthetic construct
  source 1..21: mol_type = other RNA
ctggcttatactttcttaaca

SEQ ID NO: 720 - RNA, 21 nt, synthetic construct
  source 1..21: mol_type = other RNA
ctggcttatacttccttaata

SEQ ID NO: 721 - RNA, 21 nt, synthetic construct
  source 1..21: mol_type = other RNA
ctggcactctttgcttgagga

SEQ ID NO: 722 - RNA, 21 nt, synthetic construct
  source 1..21: mol_type = other RNA
tttgcttgaggatcttccgat

SEQ ID NO: 723 - RNA, 21 nt, synthetic construct
  source 1..21: mol_type = other RNA
tgtcctgaaactgcaactaga

SEQ ID NO: 724 - RNA, 21 nt, synthetic construct
  source 1..21: mol_type = other RNA
gtcctgaaactgcaactagaa

SEQ ID NO: 725 - RNA, 21 nt, synthetic construct
  source 1..21: mol_type = other RNA
ccttcctagagcttaagatca

SEQ ID NO: 726 - RNA, 21 nt, synthetic construct
  source 1..21: mol_type = other RNA
ggggtaccagctgaattacta

SEQ ID NO: 727 - RNA, 21 nt, synthetic construct
  source 1..21: mol_type = other RNA
ggtaccagctgaattactgca

SEQ ID NO: 728 - RNA, 21 nt, synthetic construct
  source 1..21: mol_type = other RNA
ttgctgcctctttccattcta

SEQ ID NO: 729 - RNA, 21 nt, synthetic construct
  source 1..21: mol_type = other RNA
tctcctctacctggatcataa

SEQ ID NO: 730 - RNA, 21 nt, synthetic construct
  source 1..21: mol_type = other RNA
tcataatggcaatgtggtcaa

SEQ ID NO: 731 - RNA, 21 nt, synthetic construct
  source 1..21: mol_type = other RNA
ataatggcaatgtggtcaaga

SEQ ID NO: 732 - RNA, 21 nt, synthetic construct
  source 1..21: mol_type = other RNA
tgactggaggcatcagattca

SEQ ID NO: 733 - RNA, 21 nt, synthetic construct
  source 1..21: mol_type = other RNA
aaccacctggcaatatgacta

SEQ ID NO: 734 - RNA, 21 nt, synthetic construct
  source 1..21: mol_type = other RNA
tgactcacttgacccctatga

SEQ ID NO: 735 - RNA, 21 nt, synthetic construct
  source 1..21: mol_type = other RNA
cccaaatgggcactttcttgt

SEQ ID NO: 736 - RNA, 21 nt, synthetic construct
  source 1..21: mol_type = other RNA
tccaggttggctgatgtgtta

SEQ ID NO: 737 - RNA, 21 nt, synthetic construct
  source 1..21: mol_type = other RNA
aggcttgaagcagggtaagca

SEQ ID NO: 738 - RNA, 21 nt, synthetic construct
  source 1..21: mol_type = other RNA
ggcttgaagcagggtaagcaa

SEQ ID NO: 739 - RNA, 21 nt, synthetic construct
  source 1..21: mol_type = other RNA
gcactaagcctaagaagttca

SEQ ID NO: 740 - RNA, 21 nt, synthetic construct
  source 1..21: mol_type = other RNA
ctgtcacagactccacttcat

SEQ ID NO: 741 - RNA, 21 nt, synthetic construct
  source 1..21: mol_type = other RNA
tttgcttgaggatcttccgaa

SEQ ID NO: 742 - RNA, 21 nt, synthetic construct
  source 1..21: mol_type = other RNA
tgttattctgggacgattggt

SEQ ID NO: 743 - RNA, 21 nt, synthetic construct
  source 1..21: mol_type = other RNA
tgttattctgggacgattggt

SEQ ID NO: 744 - RNA, 21 nt, synthetic construct
  source 1..21: mol_type = other RNA
ttatgatccaggtagaggagt

SEQ ID NO: 745 - RNA, 21 nt, synthetic construct
  source 1..21: mol_type = other RNA
tgttattctgggatgactggt

SEQ ID NO: 746 - RNA, 21 nt, synthetic construct
  source 1..21: mol_type = other RNA
tattaagaaagtataagccag

SEQ ID NO: 747 - RNA, 21 nt, synthetic construct
  source 1..21: mol_type = other RNA
ttcggaagatcctcaagcaat

SEQ ID NO: 748 - RNA, 21 nt, synthetic construct
  source 1..21: mol_type = other RNA
tgacaagaaagtgcccatttg

SEQ ID NO: 749 - RNA, 21 nt, synthetic construct
  source 1..21: mol_type = other RNA
ttaaatgcttgtctcccagtg

SEQ ID NO: 750 - RNA, 21 nt, synthetic construct
  source 1..21: mol_type = other RNA
tgacaagaaagtgcccatctg

SEQ ID NO: 751 - RNA, 21 nt, synthetic construct
  source 1..21: mol_type = other RNA
tgacaagaaagtgcccattcg

SEQ ID NO: 752 - RNA, 23 nt, synthetic construct
  source 1..23: mol_type = other RNA
agttattctgggacgactggtct

SEQ ID NO: 753 - RNA, 21 nt, synthetic construct
  source 1..21: mol_type = other RNA
tgacaagaaagtgtccatttg

SEQ ID NO: 754 - RNA, 21 nt, synthetic construct
  source 1..21: mol_type = other RNA
tgacaagaaagtgtccattcg

SEQ ID NO: 755 - RNA, 21 nt, synthetic construct
  source 1..21: mol_type = other RNA
tgcagtaattcagctggtacc

SEQ ID NO: 756 - RNA, 21 nt, synthetic construct
  source 1..21: mol_type = other RNA
ttgaccacattgccattatga

SEQ ID NO: 757 - RNA, 21 nt, synthetic construct
  source 1..21: mol_type = other RNA
ttatgatccaggtagaggaga

---

What is claimed is:

1. An RNAi agent for inhibiting expression of an Inhibin Subunit Beta E (INHBE) gene, comprising:

an antisense strand wherein nucleotides 1-21 of the antisense strand 5'→3') comprise the nucleotide sequence (5'→3'): usAfsuuAfagaaagUfaUfaAfgccassg (SEQ ID NO: 391), wherein a represents 2'-O-methyl adenosine, c represents 2'-O-methyl cytidine, g represents 2'-O-methyl guanosine, and u represents 2'-O-methyl uridine; Af represents 2'-fluoro adenosine, Cf represents 2'-fluoro cytidine, Gf represents 2'-fluoro guanosine, and Uf represents 2'-fluoro uridine; s represents a phosphorothioate linkage, and ss represents a phosphorodithioate linkage; and a sense strand comprising the nucleotide sequence (5'→3'): CUGGCUUAUACUUUCUUAAUA (SEQ ID NO: 684);

wherein all of the nucleotides of the sense strand are modified nucleotides, wherein the modified nucleotides are selected from the group consisting of 2'-fluoro modified nucleotides and 2'-O-methyl modified nucleotides.

2. The RNAi agent of claim 1, comprising a targeting ligand linked to the 5' terminal end of the sense strand.

3. The RNAi agent of claim 1, wherein the RNAi agent comprises:
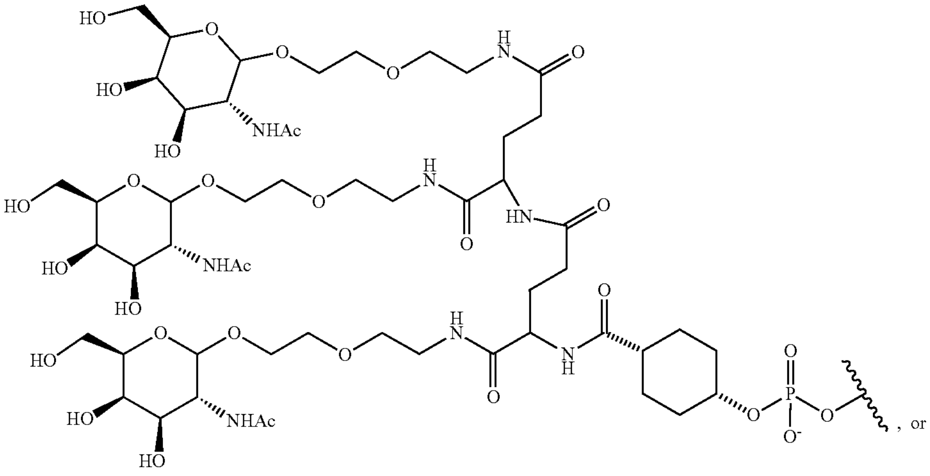
, or
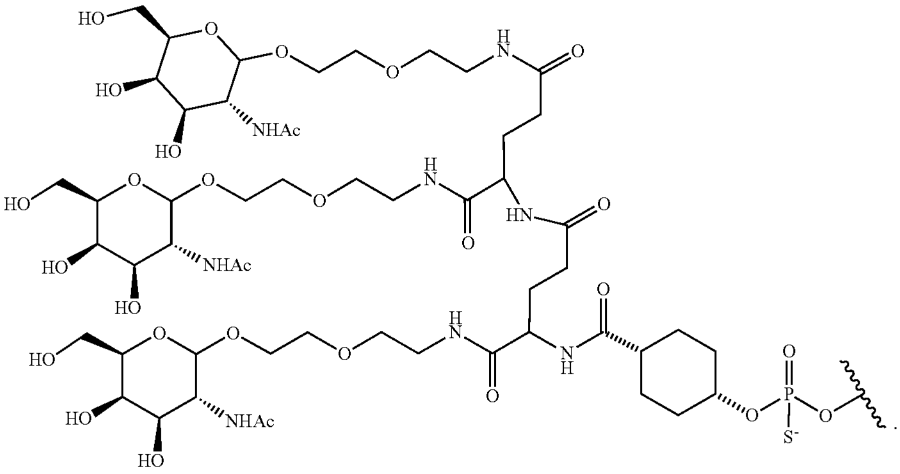
.

4. The RNAi agent of claim 1, wherein the sense strand and the antisense strand are each between 21 and 24 nucleotides in length.

5. The RNAi agent of claim 1, wherein the sense strand and the antisense strand are each 21 nucleotides in length.

6. The RNAi agent of claim 1, wherein the sense strand comprises one or two inverted abasic residues.

7. The RNAi agent of claim 1, wherein the sense strand comprises the modified nucleotide sequence (5'→3'): (NAG37)s(invAb)scuggcuuaUfaCfUfuucuuaauas(invAb) (SEQ ID NO: 515);

wherein a represents 2'-O-methyl adenosine, c represents 2'-O-methyl cytidine, g represents 2'-O-methyl guanosine, u represents 2'-O-methyl uridine; Af represents 2'-fluoro adenosine, Cf represents 2'-fluoro cytidine, Gf represents 2'-fluoro guanosine, and Uf represents 2'-fluoro uridine; s represents a phosphorothioate linkage, ss represents a phosphorodithioate linkage; (invAb) represents an inverted abasic deoxyribonucleotide; and (NAG37)s represents the following chemical structure:

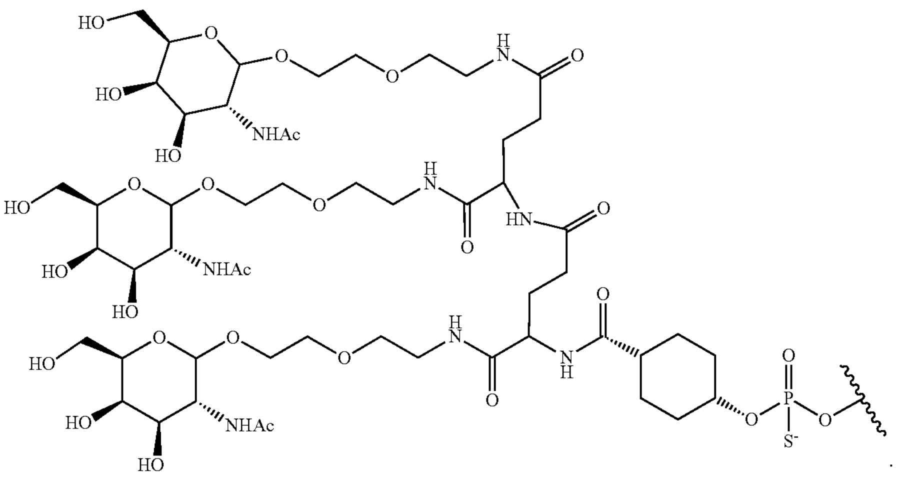

8. The RNAi agent of claim 7, wherein the RNAi agent is a pharmaceutically acceptable salt.

9. The RNAi agent of claim 8, wherein the RNAi agent is a sodium salt.

10. A pharmaceutical composition comprising the RNAi agent of claim 7, wherein the composition comprises a pharmaceutically acceptable excipient.

11. The pharmaceutical composition of claim 10, wherein the pharmaceutically acceptable excipient is isotonic saline.

12. The pharmaceutical composition of claim 11, wherein the pharmaceutically acceptable excipient is water for injection.

13. A method of inhibiting expression of an Inhibin Subunit Beta E (INHBE) gene in a cell, the method comprising introducing into the cell an effective amount of a therapeutically effective amount of the pharmaceutical composition of claim 10.

14. The method of claim 13, wherein the cell is within a subject.

15. The method of claim 14, wherein the cell is within a human subject.

16. The method of claim 15, wherein the INHBE gene expression is inhibited by at least 30%.

* * * * *